US012716071B2

(12) United States Patent
Anand et al.

(10) Patent No.: US 12,716,071 B2

(45) Date of Patent: Aug. 25, 2026

(54) METHODS FOR PLANT TRANSFORMATION

(71) Applicant: PIONEER HI-BRED INTERNATIONAL, INC., Johnston, IA (US)

(72) Inventors: Ajith Anand, West Des Moines, IA (US); William James Gordon-Kamm, Urbandale, IA (US); George J Hoerster, Des Moines, IA (US); Keith S Lowe, Johnston, IA (US); Kevin E McBride, Davis, CA (US)

(73) Assignee: PIONEER HI-BRED INTERNATIONAL, INC., Johnston, IA (US)

( * ) Notice: Subject to any disclaimer, the term of this patent is extended or adjusted under 35 U.S.C. 154(b) by 0 days.

(21) Appl. No.: 16/979,324

(22) PCT Filed: Mar. 11, 2019

(86) PCT No.: PCT/US2019/021629

§ 371 (c)(1),
(2) Date: Sep. 9, 2020

(87) PCT Pub. No.: WO2019/177976

PCT Pub. Date: Sep. 19, 2019

(65) Prior Publication Data

US 2021/0062203 A1 Mar. 4, 2021

Related U.S. Application Data

(60) Provisional application No. 62/641,733, filed on Mar. 12, 2018, provisional application No. 62/641,725, filed on Mar. 12, 2018.

(51) Int. Cl.
*C12N 15/82* (2006.01)

(52) U.S. Cl.
CPC ..... *C12N 15/8216* (2013.01); *C12N 15/8205* (2013.01)

(58) Field of Classification Search
CPC ........................ C12N 15/8213; C12N 15/8216
See application file for complete search history.

(56) References Cited

U.S. PATENT DOCUMENTS

| | | | |
|---|---|---|---|
| 4,658,082 | A | 4/1987 | Simpson et al. |
| 5,981,840 | A | 11/1999 | Zhao et al. |
| 6,284,947 | B1 | 9/2001 | Gordon-Kamm et al. |
| 6,452,068 | B1 | 9/2002 | Zuo et al. |
| 6,825,397 | B1 | 11/2004 | Lowe et al. |
| 7,166,765 | B2 | 1/2007 | Lowe et al. |
| 7,250,554 | B2 | 7/2007 | Rommens et al. |
| 7,256,322 | B2 | 8/2007 | Lowe et al. |
| 7,268,271 | B2 | 9/2007 | Lowe et al. |
| 7,449,335 | B2 | 11/2008 | Weeks et al. |
| 7,579,529 | B2 | 8/2009 | Gordon-Kamm et al. |
| 7,923,600 | B2 | 4/2011 | Richael |
| 8,137,961 | B2 | 3/2012 | Rommens |
| 8,273,949 | B2 | 9/2012 | Rommens et al. |
| 8,334,429 | B2 | 12/2012 | Ranch et al. |
| 8,420,893 | B2 * | 4/2013 | Gordon-Kamm ........................... C12N 15/8287 800/278 |
| 9,756,871 | B2 | 9/2017 | Rommens et al. |
| 11,332,752 | B2 | 5/2022 | Gasior et al. |
| 12,146,147 | B2 | 11/2024 | Gordon-Kamm et al. |
| 12,344,851 | B2 | 7/2025 | Gasior et al. |
| 2005/0034188 | A1 | 2/2005 | Weeks et al. |
| 2007/0209089 | A1 | 9/2007 | Richael |
| 2007/0250948 | A1 | 10/2007 | Rommens et al. |
| 2011/0099665 | A1 | 4/2011 | Shen et al. |
| 2011/0165679 | A1 | 7/2011 | Gordon-Kamm et al. |
| 2012/0137389 | A1 | 5/2012 | Rommens et al. |
| 2014/0068797 | A1 | 3/2014 | Doudna et al. |
| 2014/0173781 | A1 | 6/2014 | Cho et al. |
| 2016/0272988 | A1 * | 9/2016 | Hymus .............. C12N 15/8261 |
| 2017/0121722 | A1 * | 5/2017 | Anand ................... A01H 4/008 |
| 2017/0183677 | A1 | 6/2017 | Gao et al. |
| 2017/0240911 | A1 | 8/2017 | Anand et al. |
| 2022/0251587 | A1 | 8/2022 | Gasior et al. |
| 2025/0115927 | A1 | 4/2025 | Gordon-Kamm et al. |
| 2025/0290083 | A1 | 9/2025 | Gasior et al. |

FOREIGN PATENT DOCUMENTS

| | | | | |
|---|---|---|---|---|
| AU | 2010202404 | A1 * | 7/2010 | ........... C07K 14/415 |
| CN | 103842511 | A * | 6/2014 | .............. A01H 1/06 |
| TW | 317596 | B | 10/1997 | |
| WO | 0123575 | A2 | 4/2001 | |
| WO | 2002020811 | A2 | 3/2002 | |
| WO | 2005063990 | A2 | 7/2005 | |

(Continued)

OTHER PUBLICATIONS

Miller et al (High efficiency transgene segregation in co-transformed maize plants using an Agrobacterium tumefaciens 2 T-DNA binary system. Transgenic Research. 11:381-396, 2002). (Year: 2002).*

Hwang et al (Agrobacterium-mediated plant transformation: biology and applications. American Society of Plant Biologists. 1-31, 2017) (Year: 2017).*

Rathore et al (Alternative Non-Agrobacterium Based Methods for Plant Transformation. Annual Plant Reviews. 1, 1-17, 2018) (Year: 2018).*

Dykhuizen et al (Species Numbers in Bacteria. Proc Calif Acad Sci. 56(6 Suppl 1): 62-71, 2005) (Year: 2005).*

Zhao et al (Development of Transgenic Glyphosate-Resistant Rice with G6 Gene Encoding 5-Enolpyruvylshikimate-3-Phosphate Synthase. Agricultural Sciences in China. 10(9): 1307-1312, 2011) (Year: 2011).*

(Continued)

*Primary Examiner* — Wayne Zhong

(57) ABSTRACT

The methods disclosed herein use a morphogenic gene or a repressor gene to provide a transgenic plant containing a single copy of a transgenic event wherein the morphogenic gene or the repressor gene does not integrate into the genome of the plant and the plant does not contain vector (plasmid) backbone.

31 Claims, 1 Drawing Sheet

Specification includes a Sequence Listing.

(56) References Cited

FOREIGN PATENT DOCUMENTS

| | | | | |
|---|---|---|---|---|
| WO | WO-2005075655 A2 * | 8/2005 | .............. A01H 1/08 |
| WO | 2007/092308 A2 | 8/2007 | |
| WO | 2008/085605 A2 | 7/2008 | |
| WO | 2010062518 A1 | 6/2010 | |
| WO | 2011/082318 A2 | 7/2011 | |
| WO | 2011082310 A2 | 7/2011 | |
| WO | 2012129373 A2 | 9/2012 | |
| WO | 2015026883 A1 | 2/2015 | |
| WO | 2015/191374 A1 | 12/2015 | |
| WO | 2016/007948 A1 | 1/2016 | |
| WO | 2016007347 A1 | 1/2016 | |
| WO | 2016149352 A1 | 9/2016 | |
| WO | WO-2017040343 A1 * | 3/2017 | ........... C07K 14/195 |
| WO | 2017/074547 A1 | 5/2017 | |
| WO | 2017222773 A1 | 12/2017 | |

OTHER PUBLICATIONS

Lacroix et al (A Functional Bacterium-to-Plant DNA Transfer Machinery of Rhizobium etli. PLOS Pathogens 1-15, 2016) (Year: 2016).*

Li et al (The FAST technique: a simplified Agrobacterium-based transformation method for transient gene expression analysis in seedlings of *Arabidopsis* and other plant species. Plant method, 1-15, 2009) (Year: 2009).*

Lowe_2016_Supplemental_Data (Year: 2016).*

Gordon-Kamm et al (Review. Using Morphogenic Genes to Improve Recovery and Regeneration of Transgenic Plants. Plants, p. 1-18, 2019) (Year: 2019).*

Youngstrom et al (Focused Review. Unlocking regeneration potential: hamessing morphogenic regulators and small peptides for enhanced plant engineering. The Plant Journal, p. 1-18, 2025) (Year: 2025).*

Lowe et al.(Morphogenic Regulators Baby boom and Wuschel Improve Monocot Transformation, The Plant Cell. vol. 28: 1998-2015, 2016). (Year: 2016).*

Gelvin (Agrobacterium-Mediated Plant Transformation: the Biology Behind the "Gene-Jockeying" Tool. Microbiology and Molecular Biology Reviews, p. 16-37, 2003). (Year: 2003).*

Aronen, Tuija S.; et al.: "Applicability of the co-inoculation technique using Agrobacterium tumefaciens shooty-tumour strain 82.139 in silver birch," Plant Cell, Tissue and Organ Culture, 2002, vol. 70, pp. 147-154.

Brasileiro, Ana Cristina Miranda Brasileiro; et al.: "An alternative approach for gene transfer in trees using wild-type Agrobacterium strains," Plant Molecular Biology, 1991, vol. 17, pp. 441-452.

Brasileiro, Ana Cristina Miranda Brasileiro; et al.: "Expression of the mutant *Arabidopsis thaliana* acetolactate synthase gene confers chlorsulfuron resistance to transgenic poplar plants," Transgenic Research, 1992, vol. 1, pp. 133-141.

Confalonieri, Massimo; et al.: "Backbone-free transformation of barrell medic (*Medicago truncatula*) with a Medicago-derived transfer DNA," Plant Cell Rep, 2010, vol. 29, pp. 1013-1021.

De Block, Marc; et al.: "Two T-DNA's co-transformed into Brassica napus by a double Agrobacterium tumefaciens Infection are mainly integrated at the same locus," Theor Appl Genet, Jan. 23, 1991 (Jan. 23, 1991), vol. 82, pp. 257-263.

De Neve, Myriam; et al.: "T-DNA integration patters in co-transformed plant cells suggest that T-DNA repeats originate from co-integration of separate T-DNAs," The Plant Journal, 1997, vol. 11, No. 1, pp. 15-29.

Dutt, M.; et al.: "A co-transformation system to produce transgenic grapevines free of marker genes," Plant Science, Jul. 4, 2008 (Jul. 4, 2008), vol. 175, pp. 423-430.

Florez, et al.: "Enhanced somatic embryogenesis in Theobroma cacao using the homologous Baby Boom transcription factor," BMC Plant Biology, 2015, vol. 15, No. 121, pp. 1-12.

Gallois, Jean-Luc; et al.: "Combined Shoot Meristemless and Wuschel trigger ectopic organogenesis in *Arabidopsis*," Development, Apr. 9, 2002 (Apr. 9, 2002), vol. 129, pp. 3207-3217.

Gilbert, Luke A.; et al.: "CRISPR-Mediated Modular RNA-Guided Regulation of Transcription in Eukaryotes," Cell, Jul. 18, 2013 (Jul. 18, 2013), vol. 154, No. 2, pp. 442-451.

Huang, Shihshieh; et al.: "Generation of marker-free transgenic maize by regular two-border Agrobacterium transformation vectors," Transgenic Research, May 11, 2004 (May 11, 2004), vol. 13, pp. 451-461.

Kagale, Sateesh; et al.: "Small yet effect: The Ethylene-responsive element binding factor-associated Amphiphilic Repression (EAR) motif," Plant Signaling & Behavior, Jun. 2010 (Jun. 2010), vol. 5, Issue 6, pp. 691-694.

Kiani, Samira; et al.: "Cas9 gRNA engineering for genome editing, activation and repression," Nature Methods, Nov. 2015 (Nov. 2015), vol. 12, No. 11, pp. 1051-1054.

Lowe, Keith; et al.: "Morphogenic Regulators Baby boom and Wuschel Improve Monocot Transformation", The Plant Cell, Sep. 10, 2016 (Sep. 10, 2016), vol. 28, No. 9, pp. 1998-2015.

McNight, Thomas D.; et al.: "Segregation of genes transferred to one plant cell from two separate Agrobacterium strains," Plant Molecular Biology, Feb. 6, 1987(Feb. 6, 1987), vol. 8, pp. 439-445.

Mihalka, V.; et al.: "Binary transformation systems based on 'shooter' mutants of Agrobacterium tumefaciens: a simple, efficient and universal gene transfer technology that permits marker gene elimination," Plant Cell Rep, Mar. 15, 2003 (Mar. 15, 2003), vol. 21, pp. 778-784.

Molinier, J.; et al.: "Transient expression of ipt gene enhances regeneration and transformation rates of sunflower shoot apices (*Helianthus annuus* L.)," Plant Cell Rep, Aug. 21, 2002 (Aug. 21, 2002), vol. 21, pp. 251-256.

Owens, Lowell D.; et al.: "Transformation of Soybean Cells Using Mixed Strains of Agrobacterium tumefaciens and Phenolic Compounds," Plant Physiol., May 6, 1988 (May 6, 1988), vol. 88. pp. 570-573.

Puchta, Holger: "Marker-free transgenic plants," Plant Cell, Tissue and Organ Culture, Feb. 6, 2003 (Feb. 6, 2003), vol. 74, pp. 123-134.

Ramanarao, Mangu Venkata; et al.: "Selectable marker elimination in the T0 generation by Agrobacterium-mediated co-transformation involving Mungbean yellow mosaic virus TrAP as a non-conditional negative selectable marker and bar for transient positive selection," Plant Cell Rep, Mar. 5, 2010 (Mar. 5, 2010), vol. 29, pp. 473-483.

Richael, Craig M.; et al.: "Cytokinin vectors mediate marker-free and backbone-free plant transformation," Transgenic Res, Mar. 5, 2008 (Mar. 5, 2008), vol. 17, pp. 905-917.

Richael, Craig M.; et al.: "Employment of Cytokinin Vectors for Marker-Free and Backbone-Free Transformation," Transgenic Plants Methods and Protocols, vol. 847, pp. 3-10.

Rommens, Caius M.; et al.: "Plant-Derived Transfer DNAs," Plant Physiology, Nov. 2005 (Nov. 2005), vol. 139, pp. 1338-1349.

Thole, Vera; et al.: "The pCLEAN Dual Binary Vector System for Agrobacterium-Mediated Plant Transformation," Plant Physiology, Dec. 2007 (Dec. 2007), vol. 145, pp. 1211-1219.

Urrutia, Raul: "KRAB-containing zinc-finger repressor proteins," Genome Biology, Sep. 23, 2003 (Sep. 23, 2003), vol. 4, Issue 10 Article 231.

Wang, Gen-Ping; et al.: "Generation of Marker- and/or Backbone-Free Transgenic Wheat Plants via Agrobacterium-Mediated Transformation," Frontiers in Plant Science, Sep. 21, 2016 (Sep. 21, 2016), vol. 7, Article 1324.

Zhong, Heng; et al.: "In-Vitro morphogenesis of corn (*Zea mays* L.)," Planta, Mar. 23, 1992 (Mar. 23, 1992), vol. 187, pp. 490-497.

International Search Report and Written Opinion for International Application No. PCT/US2019/021629, Mailed Jul. 17, 2019.

Eudes, Francois; et al.: "Cell-Pentrating Peptides," Plant Signaling & Behavior, Aug. 2008, vol. 3, No. 8, pp. 549-550.

Ramakrishna, et al.: "Gene Disruption by Cell-Penetrating Peptide-Mediated Delivery of Cas9 Protein and Guide RNA," Genome Research (2014) 24(6): 1020-1027.

Ziemienowicz, et al. 2015 (Cell-Penetrating Peptides: Methods and Protocols, Methods in Molecular Biology 1324) (Year: 2015).

Non-Final Office Action Issued Sep. 14, 2021 for U.S. Appl. No. 16/979,917.

(56) References Cited

OTHER PUBLICATIONS

International Search Report and Written Opinion for International Application No. PCT/US19/21631, issued on May 29, 2019.
Extended European Search Report for European Application No. 19767798.2, mailed Jan. 10, 2022, 7 Pages.
International Preliminary Report on Patentability for International Application No. PCT/US2019/021629, mailed Sep. 24, 2020, 7 Pages.
International Preliminary Report on Patentability for International Application No. PCT/US2019/021631, mailed Sep. 24, 2020, 10 Pages.
Lowder L.G., et al., "A CRISPR/Cas9 Toolbox for Multiplexed Plant Genome Editing and Transcriptional Regulation," Plant Physiology, Oct. 2015, vol. 169, No. 2, ISSN 0032-0889, pp. 971-985.

* cited by examiner

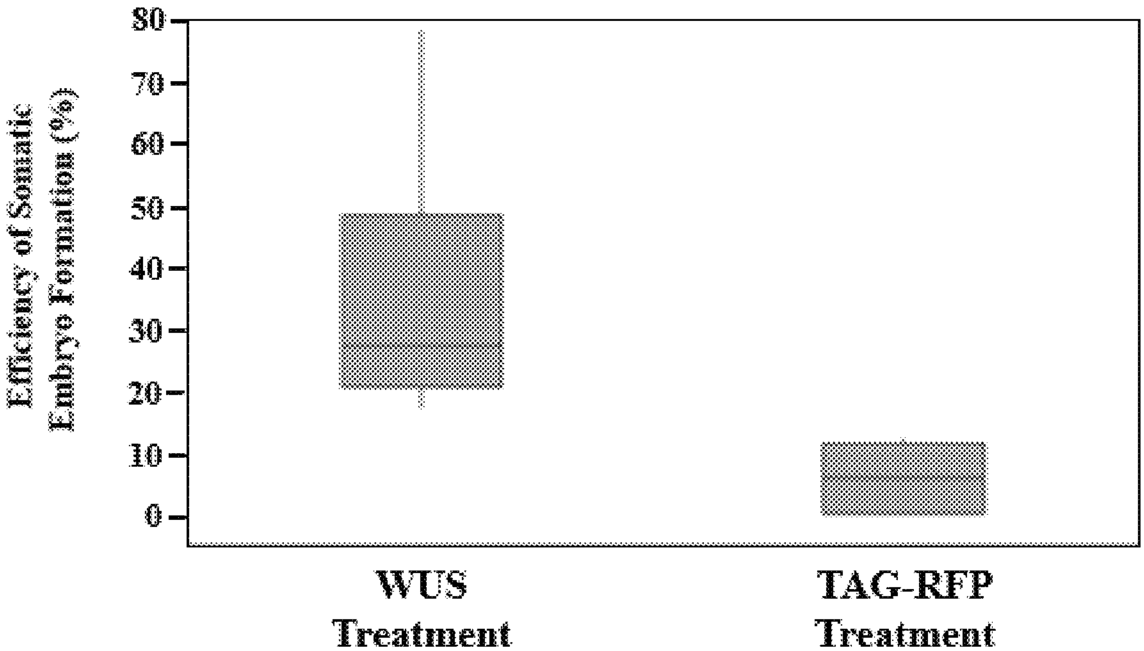
80
70
60
50
40
30
20
10
0
Efficiency of Somatic Embryo Formation (%)
WUS Treatment
TAG-RFP Treatment

METHODS FOR PLANT TRANSFORMATION

CROSS-REFERENCE TO RELATED APPLICATIONS

This application claims the benefit of PCT Application Serial Number PCT/US2019/021629, filed Mar. 11, 2019, which claims the benefit of U.S. Provisional Patent Application Ser. No. 62/641,725, filed Mar. 12, 2018 and U.S. Provisional Patent Application Ser. No. 62/641,733 filed 12 Mar. 2018, each of which are hereby incorporated herein by reference in their entireties.

FIELD OF THE DISCLOSURE

The present disclosure relates generally to the field of plant molecular biology, including genetic manipulation of plants. More specifically, the present disclosure pertains to rapid, high efficiency methods for producing a transformed plant.

REFERENCE TO A SEQUENCE LISTING SUBMITTED AS A TEXT FILE VIA EFS-WEB

The official copy of the sequence listing is submitted electronically via EFS-Web as an ASCII formatted sequence listing with a file named 7486-US-PCT_SeqList, created on Sep. 3, 2020, and having a size of 803,226 bytes and is filed concurrently with the specification. The sequence listing contained in this ASCII formatted document is part of the specification and is herein incorporated by reference in its entirety.

BACKGROUND

The use of standard transformation and regeneration protocols is time consuming and inefficient, and negatively impacts transgenic product development timelines, given that there is usually a seasonally limited "priority development window" for making decisions regarding which genetic constructs to prioritize for use in larger scale field work based on results obtained during initial research. The available standard methods of transformation and regeneration have multiple drawbacks that limit the speed and efficiency with which transgenic plants can be produced and screened. For example, many standard methods of transformation and regeneration require the use of high auxin or cytokinin levels and require steps involving either embryogenic callus formation or organogenesis, leading to procedures that take many weeks before producing plants for growth in a greenhouse setting following transformation. There remains a need for transformation methods that produce significantly higher transformation frequencies and significantly more quality events (events containing one copy of a trait gene expression cassette with no vector (plasmid) backbone) in multiple inbred lines using a variety of starting tissue types, including transformed inbreds representing a range of genetic diversities and having significant commercial utility.

SUMMARY

The present disclosure comprises methods and compositions for producing transgenic events that contain one copy of a trait gene. In a further aspect, the present disclosure provides a seed from the plant produced by the methods disclosed herein.

In an aspect, the disclosure provides a method of producing a transgenic plant having one copy of a trait gene expression cassette comprising: contacting a plant cell with a T-DNA containing a trait gene expression cassette and a T-DNA containing a morphogenic gene expression cassette; selecting a plant cell containing the trait gene expression cassette and no morphogenic gene expression cassette; and regenerating a transgenic plant from the plant cell. In a further aspect, contacting comprises simultaneously contacting a plant cell with a T-DNA containing a trait gene expression cassette in a first bacterial strain and a T-DNA containing a morphogenic gene expression cassette in a second bacterial strain. In yet a further aspect, contacting comprises contacting a plant cell with one bacterial strain containing a plasmid that comprises a trait gene expression cassette within the T-DNA and a morphogenic gene expression cassette outside of the T-DNA. In yet another aspect, contacting comprises contacting a plant cell with the T-DNA containing a trait gene expression cassette and the T-DNA containing a morphogenic gene expression cassette in one bacterial strain. In a further aspect, the morphogenic gene expression cassette comprises: (i) a nucleotide sequence encoding a WUS/WOX homeobox polypeptide; or (ii) a nucleotide sequence encoding a Babyboom (BBM) polypeptide or an Ovule Development Protein 2 (ODP2) polypeptide; or (iii) a combination of (i) and (ii). In a further aspect, the nucleotide sequence encodes the WUS/WOX homeobox polypeptide. In a further aspect, the nucleotide sequence encoding the WUS/WOX homeobox polypeptide is selected from WUS1, WUS2, WUS3, WOX2A, WOX4, WOX5, and WOX9. In a further aspect, the nucleotide sequence encodes the Babyboom (BBM) polypeptide or the Ovule Development Protein 2 (ODP2) polypeptide. In a further aspect, the nucleotide sequence encoding the Babyboom (BBM) polypeptide is selected from BBM2, BMN2, and BMN3 or the Ovule Development Protein 2 (ODP2) polypeptide is ODP2. In a further aspect, the nucleotide sequence encodes the WUS/WOX homeobox polypeptide and the Babyboom (BBM) polypeptide or the Ovule Development Protein 2 (ODP2) polypeptide. In a further aspect, the nucleotide sequence encoding the WUS/WOX homeobox polypeptide is selected from WUS1, WUS2, WUS3, WOX2A, WOX4, WOX5, and WOX9 and the Babyboom (BBM) polypeptide is selected from BBM2, BMN2, and BMN3 or the Ovule Development Protein 2 (ODP2) polypeptide is ODP2. In a further aspect, the trait gene expression cassette comprises: a trait gene selected from the group of a gene conferring pest resistance, a gene conferring herbicide resistance, a gene conferring stress tolerance, a gene conferring drought resistance, a gene conferring nitrogen use efficiency (NUE), a gene conferring disease resistance, and a gene conferring an ability to alter a metabolic pathway. In a further aspect, the first bacterial strain and the second bacterial strain are the same bacterial strain. In a further aspect, the same bacterial strain is a Rhizobiales selected from the group of a disarmed *Agrobacteria*, an *Ochrobactrum* bacteria, and a *Rhizobiaceae* bacteria. In a further aspect, the disarmed *Agrobacteria* is selected from the group of AGL-1, EHA105, GV3101, LBA4404, and LBA4404 THY-. In a further aspect, the *Ochrobactrum* bacteria is selected from Table 2. In a further aspect, the *Rhizobiaceae* bacteria is selected from Table 3. In yet a further aspect, the first bacterial strain and the second bacterial strain are different bacterial strains. In a further aspect, the different bacterial strains are selected from: (i) a disarmed *Agrobacteria* and an *Ochrobactrum* bacteria; (ii) a disarmed *Agrobacteria* and a *Rhizobiaceae* bacteria; and (iii) a *Rhizobiaceae* bacteria and an *Ochrobactrum* bacteria. In a further aspect, the disarmed *Agrobacteria* is selected from the group of AGL-1, EHA105, GV3101, LBA4404, and LBA4404 THY-. In a further aspect, the *Ochrobactrum* bacteria is selected from Table 2. In a further aspect, the *Rhizobiaceae* bacteria is selected from Table 3. In a further aspect, the first bacterial strain and the second bacterial strain are present in a 50:50 ratio. In a further aspect, the first bacterial strain and the second bacterial strain are present in a 75:25 ratio. In a further aspect, the first bacterial strain and the second bacterial strain are present in a 90:10 ratio. In a further aspect, the first bacterial strain and the second bacterial strain are present in a 95:5 ratio. In a further aspect, the first bacterial strain and the second bacterial strain are present in a 99:1 ratio. In a further aspect, the morphogenic gene expression cassette further comprises a promoter selected from Table 4 or Table 5. In a further aspect, the morphogenic gene expression cassette comprises a PLTP promoter operably linked to a WUS gene. In a further aspect, the morphogenic gene expression cassette comprises a HBSTART3 promoter operably linked to a WUS gene. In a further aspect, the morphogenic gene expression cassette comprises a PLTP promoter operably linked to a WUS gene and a Ubiquitin promoter operably linked to a LEC1 gene. In a further aspect, the morphogenic gene expression cassette comprises a PLTP promoter operably linked to a WUS gene and a PLTP promoter operably linked to a LEC1 gene. In a further aspect, the morphogenic gene expression cassette comprises a PLTP promoter operably linked to a WUS gene fused to a T2A viral peptide LEC1 gene fusion. In a further aspect, the morphogenic gene expression cassette further comprises a viral or plant enhancer sequence. In a further aspect, the morphogenic gene expression cassette comprises a PLTP promoter operably linked to a WUS gene fused to a T2A viral peptide BBM gene fusion. In a further aspect, the morphogenic gene expression cassette comprises a PLTP promoter operably linked to a WUS gene fused to a T2A viral peptide RepA gene fusion. In a further aspect, the morphogenic gene expression cassette comprises a PLTP promoter operably linked to a WUS gene and a PLTP promoter operably linked to a PKLamiRNA fusion. In a further aspect, a plant seed containing the trait gene expression cassette is provided.

In an aspect, the disclosure provides a method of producing a transgenic plant having one copy of a trait gene expression cassette and one copy of a selectable marker expression cassette comprising: contacting a plant cell with a bacterial strain containing a plasmid that comprises a T-DNA having a right border and a left border flanking a trait gene expression cassette and a selectable marker expression cassette, and outside of the T-DNA a repressor gene expression cassette, wherein the selectable marker expression cassette comprises a promoter that is repressed by a repressor polypeptide expressed by a repressor gene; selecting a plant cell containing the trait gene expression cassette and the selectable marker expression cassette and no repressor gene expression cassette; and regenerating a transgenic plant from the plant cell. In a further aspect, the repressor gene expression cassette comprises a nucleotide sequence encoding the tetracycline repressor (TETR), a ethametsulfuron repressor (ESR), a chlorsulfuron repressor (CSR), and a repressor-dCAS9 fusion having a guide RNA targeting the promoter in the T-DNA. In a further aspect, the nucleotide sequence encodes the tetracycline repressor (TETR) repressing the promoter operably linked to the selectable marker in the T-DNA. In a further aspect, the nucleotide sequence encodes the ethametsulfuron repressor (ESR) repressing the promoter operably linked to the selectable marker in the T-DNA. In a further aspect, the nucleotide sequence encodes the chlorsulfuron repressor (CSR) repressing the promoter operably linked to the selectable marker in the T-DNA. In a further aspect, the nucleotide sequence encodes the repressor-dCAS9 fusion having a guide RNA repressing the promoter operably linked to the selectable marker in the T-DNA. In a further aspect, the trait gene expression cassette comprises: a trait gene selected from the group of a gene conferring pest resistance, a gene conferring herbicide resistance, a gene conferring stress tolerance, a gene conferring drought resistance, a gene conferring nitrogen use efficiency (NUE), a gene conferring disease resistance, and a gene conferring an ability to alter a metabolic pathway. In a further aspect, the bacterial strain is a Rhizobiales selected from the group of a disarmed *Agrobacteria*, an *Ochrobactrum* bacteria and a *Rhizobiaceae* bacteria. In a further aspect, the disarmed *Agrobacteria* is selected from the group of AGL-1, EHA105, GV3101, LBA4404, and LBA4404 THY-. In a further aspect, the *Ochrobactrum* bacteria is selected from Table 2. In a further aspect, the *Rhizobiaceae* bacteria is selected from Table 3. In a further aspect, a plant seed containing the trait gene expression cassette is provided.

In an aspect, the disclosure provides a method of producing a transgenic plant having one copy of a trait gene expression cassette comprising: simultaneously contacting a plant cell with a T-DNA containing a trait gene expression cassette in a first bacterial strain and a T-DNA containing a morphogenic gene expression cassette in a second bacterial strain; wherein the morphogenic gene expression cassette comprises: (i) a nucleotide sequence encoding a WUS/WOX homeobox polypeptide; or (ii) a nucleotide sequence encoding a Babyboom (BBM) polypeptide or an Ovule Development Protein 2 (ODP2) polypeptide; or (iii) a combination of (i) and (ii); wherein the trait gene expression cassette comprises: a trait gene selected from the group of a gene conferring pest resistance, a gene conferring herbicide resistance, a gene conferring stress tolerance, a gene conferring drought resistance, a gene conferring nitrogen use efficiency (NUE), a gene conferring disease resistance, and a gene conferring an ability to alter a metabolic pathway; selecting a plant cell containing the trait gene expression cassette and no morphogenic gene expression cassette; and regenerating a transgenic plant from the plant cell. In a further aspect, the nucleotide sequence encodes the WUS/WOX homeobox polypeptide. In a further aspect, the nucleotide sequence encoding the WUS/WOX homeobox polypeptide is selected from WUS1, WUS2, WUS3, WOX2A, WOX4, WOX5, and WOX9. In a further aspect, the nucleotide sequence encodes the Babyboom (BBM) polypeptide or the Ovule Development Protein 2 (ODP2) polypeptide. In a further aspect, the nucleotide sequence encoding the Babyboom (BBM) polypeptide is selected from BBM2, BMN2, and BMN3 or the Ovule Development Protein 2 (ODP2) polypeptide is ODP2. In a further aspect, the nucleotide sequence encodes the WUS/WOX homeobox polypeptide and the Babyboom (BBM) polypeptide or the Ovule Development Protein 2 (ODP2) polypeptide. In a further aspect, the nucleotide sequence encoding the WUS/WOX homeobox polypeptide is selected from WUS1, WUS2, WUS3, WOX2A, WOX4, WOX5, and WOX9 and the Babyboom (BBM) polypeptide is selected from BBM2, BMN2, and BMN3 or the Ovule Development Protein 2 (ODP2) polypeptide is ODP2. In a further aspect, the first bacterial strain and the second bacterial strain are the same bacterial strain. In a further aspect, the same bacterial strain is a Rhizobiales selected from the group of a disarmed *Agrobacteria*, an *Ochrobactrum* bacteria, and a *Rhizobiaceae* bacteria. In a further aspect, the disarmed *Agrobacteria* is selected from the group of AGL-1, EHA105, GV3101, LBA4404, and LBA4404 THY-. In a further aspect, the *Ochrobactrum* bacteria is selected from Table 2. In a further aspect, the *Rhizobiaceae* bacteria is selected from Table 3. In a further aspect, the first bacterial strain and the second bacterial strain are different bacterial strains. In a further aspect, the different bacterial strains are selected from: (i) a disarmed *Agrobacteria* and an *Ochrobactrum* bacteria; (ii) a disarmed *Agrobacteria* and a *Rhizobiaceae* bacteria; and (iii) a *Rhizobiaceae* bacteria and an *Ochrobactrum* bacteria. In a further aspect, the disarmed *Agrobacteria* is selected from the group of AGL-1, EHA105, GV3101, LBA4404, and LBA4404 THY-. In a further aspect, the *Ochrobactrum* bacteria is selected from Table 2. In a further aspect, the *Rhizobiaceae* bacteria is selected from Table 3. In a further aspect, the first bacterial strain and the second bacterial strain are present in a 50:50 ratio. In a further aspect, the first bacterial strain and the second bacterial strain are present in a 75:25 ratio. In a further aspect, the first bacterial strain and the second bacterial strain are present in a 90:10 ratio. In a further aspect, the first bacterial strain and the second bacterial strain are present in a 95:5 ratio. In a further aspect, the first bacterial strain and the second bacterial strain are present in a 99:1 ratio. In a further aspect, the morphogenic gene expression cassette further comprises a promoter selected from Table 4 or Table 5. In a further aspect, the morphogenic gene expression cassette comprises a PLTP promoter operably linked to a WUS gene. In a further aspect, the morphogenic gene expression cassette comprises a HBSTART3 promoter operably linked to a WUS gene. In a further aspect, the morphogenic gene expression cassette comprises a PLTP promoter operably linked to a WUS gene and a Ubiquitin promoter operably linked to a LEC1 gene. In a further aspect, the morphogenic gene expression cassette comprises a PLTP promoter operably linked to a WUS gene and a PLTP promoter operably linked to a LEC1 gene. In a further aspect, the morphogenic gene expression cassette comprises a PLTP promoter operably linked to a WUS gene fused to a T2A viral peptide LEC1 gene fusion. In a further aspect, the morphogenic gene expression cassette further comprises a viral or plant enhancer sequence. In a further aspect, the morphogenic gene expression cassette comprises a PLTP promoter operably linked to a WUS gene fused to a T2A viral peptide BBM gene fusion. In a further aspect, the morphogenic gene expression cassette comprises a PLTP promoter operably linked to a WUS gene fused to a T2A viral peptide RepA gene fusion. In a further aspect, the morphogenic gene expression cassette comprises a PLTP promoter operably linked to a WUS gene and a PLTP promoter operably linked to a PKLamiRNA fusion. In a further aspect, a plant seed containing the trait gene expression cassette is provided.

In an aspect, the disclosure provides a method of producing a transgenic plant having one copy of a trait gene expression cassette comprising: contacting a plant cell with one bacterial strain containing a plasmid that comprises a trait gene expression cassette within the T-DNA and a morphogenic gene expression cassette outside of the T-DNA; wherein the morphogenic gene expression cassette comprises: (i) a nucleotide sequence encoding a WUS/WOX homeobox polypeptide; or (ii) a nucleotide sequence encoding a Babyboom (BBM) polypeptide or an Ovule Development Protein 2 (ODP2) polypeptide; or (iii) a combination of (i) and (ii); wherein the trait gene expression cassette comprises: a trait gene selected from the group of a gene conferring pest resistance, a gene conferring herbicide resistance, a gene conferring stress tolerance, a gene conferring drought resistance, a gene conferring nitrogen use efficiency (NUE), a gene conferring disease resistance, and a gene conferring an ability to alter a metabolic pathway; selecting a plant cell containing the trait gene expression cassette and no morphogenic gene expression cassette; and regenerating a transgenic plant from the plant cell. In a further aspect, the nucleotide sequence encodes the WUS/WOX homeobox polypeptide. In a further aspect, the nucleotide sequence encoding the WUS/WOX homeobox polypeptide is selected from WUS1, WUS2, WUS3, WOX2A, WOX4, WOX5, and WOX9. In a further aspect, the nucleotide sequence encodes the Babyboom (BBM) polypeptide or the Ovule Development Protein 2 (ODP2) polypeptide. In a further aspect, the nucleotide sequence encoding the Babyboom (BBM) polypeptide is selected from BBM2, BMN2, and BMN3 or the Ovule Development Protein 2 (ODP2) polypeptide is ODP2. In a further aspect, the nucleotide sequence encodes the WUS/WOX homeobox polypeptide and the Babyboom (BBM) polypeptide or the Ovule Development Protein 2 (ODP2) polypeptide. In a further aspect, the nucleotide sequence encoding the WUS/WOX homeobox polypeptide is selected from WUS1, WUS2, WUS3, WOX2A, WOX4, WOX5, and WOX9 and the Babyboom (BBM) polypeptide is selected from BBM2, BMN2, and BMN3 or the Ovule Development Protein 2 (ODP2) polypeptide is ODP2. In a further aspect, the bacterial strain is a Rhizobiales selected from the group of a disarmed *Agrobacteria*, an *Ochrobactrum* bacteria, and a *Rhizobiaceae* bacteria. In a further aspect, the disarmed *Agrobacteria* is selected from the group of AGL-1, EHA105, GV3101, LBA4404, and LBA4404 THY-. In a further aspect, the *Ochrobactrum* bacteria is selected from Table 2. In a further aspect, the *Rhizobiaceae* bacteria is selected from Table 3. In a further aspect, the morphogenic gene expression cassette further comprises a promoter selected from Table 4 or Table 5. In a further aspect, the morphogenic gene expression cassette comprises a PLTP promoter operably linked to a WUS gene. In a further aspect, the morphogenic gene expression cassette comprises a HBSTART3 promoter operably linked to a WUS gene. In a further aspect, the morphogenic gene expression cassette comprises a PLTP promoter operably linked to a WUS gene and a Ubiquitin promoter operably linked to a LEC1 gene. In a further aspect, the morphogenic gene expression cassette comprises a PLTP promoter operably linked to a WUS gene and a PLTP promoter operably linked to a LEC1 gene. In a further aspect, the morphogenic gene expression cassette comprises a PLTP promoter operably linked to a WUS gene fused to a T2A viral peptide LEC1 gene fusion. In a further aspect, the morphogenic gene expression cassette further comprises a viral or plant enhancer sequence. In a further aspect, the morphogenic gene expression cassette comprises a PLTP promoter operably linked to a WUS gene fused to a T2A viral peptide BBM gene fusion. In a further aspect, the morphogenic gene expression cassette comprises a PLTP promoter operably linked to a WUS gene fused to a T2A viral peptide RepA gene fusion. In a further aspect, the morphogenic gene expression cassette comprises a PLTP promoter operably linked to a WUS gene and a PLTP promoter operably linked to a PKLamiRNA fusion. In a further aspect, a plant seed containing the trait gene expression cassette is provided.

In an aspect, the disclosure provides a method of producing a transgenic plant having one copy of a trait gene expression cassette comprising: contacting a plant cell with one bacterial strain comprising a T-DNA containing a trait gene expression cassette and a T-DNA containing a morphogenic gene expression cassette; wherein the morphogenic gene expression cassette comprises: (i) a nucleotide sequence encoding a WUS/WOX homeobox polypeptide; or (ii) a nucleotide sequence encoding a Babyboom (BBM) polypeptide or an Ovule Development Protein 2 (ODP2) polypeptide; or (iii) a combination of (i) and (ii); wherein the trait gene expression cassette comprises: a trait gene selected from the group of a gene conferring pest resistance, a gene conferring herbicide resistance, a gene conferring stress tolerance, a gene conferring drought resistance, a gene conferring nitrogen use efficiency (NUE), a gene conferring disease resistance, and a gene conferring an ability to alter a metabolic pathway; selecting a plant cell containing the trait gene expression cassette and no morphogenic gene expression cassette; and regenerating a transgenic plant from the plant cell. In a further aspect, the nucleotide sequence encodes the WUS/WOX homeobox polypeptide. In a further aspect, the nucleotide sequence encoding the WUS/WOX homeobox polypeptide is selected from WUS1, WUS2, WUS3, WOX2A, WOX4, WOX5, and WOX9. In a further aspect, nucleotide sequence encodes the Babyboom (BBM) polypeptide or the Ovule Development Protein 2 (ODP2) polypeptide. In a further aspect, the nucleotide sequence encoding the Babyboom (BBM) polypeptide is selected from BBM2, BMN2, and BMN3 or the Ovule Development Protein 2 (ODP2) polypeptide is ODP2. In a further aspect, the nucleotide sequence encodes the WUS/WOX homeobox polypeptide and the Babyboom (BBM) polypeptide or the Ovule Development Protein 2 (ODP2) polypeptide. In a further aspect, the nucleotide sequence encoding the WUS/WOX homeobox polypeptide is selected from WUS1, WUS2, WUS3, WOX2A, WOX4, WOX5, and WOX9 and the Babyboom (BBM) polypeptide is selected from BBM2, BMN2, and BMN3 or the Ovule Development Protein 2 (ODP2) polypeptide is ODP2. In a further aspect, the one bacterial strain is a Rhizobiales selected from the group of a disarmed *Agrobacteria*, an *Ochrobactrum* bacteria, and a *Rhizobiaceae* bacteria. In a further aspect, the disarmed *Agrobacteria* is selected from the group of AGL-1, EHA105, GV3101, LBA4404, and LBA4404 THY-. In a further aspect, the *Ochrobactrum* bacteria is selected from Table 2. In a further aspect, the *Rhizobiaceae* bacteria is selected from Table 3. In a further aspect, the morphogenic gene expression cassette further comprises a promoter selected from Table 4 or Table 5. In a further aspect, the morphogenic gene expression cassette comprises a PLTP promoter operably linked to a WUS gene. In a further aspect, the morphogenic gene expression cassette comprises a HBSTART3 promoter operably linked to a WUS gene. In a further aspect, the morphogenic gene expression cassette comprises a PLTP promoter operably linked to a WUS gene and a Ubiquitin promoter operably linked to a LEC1 gene. In a further aspect, the morphogenic gene expression cassette comprises a PLTP promoter operably linked to a WUS gene and a PLTP promoter operably linked to a LEC1 gene. In a further aspect, the morphogenic gene expression cassette comprises a PLTP promoter operably linked to a WUS gene fused to a T2A viral peptide LEC1 gene fusion. In a further aspect, the morphogenic gene expression cassette further comprises a viral or plant enhancer sequence. In a further aspect, the morphogenic gene expression cassette comprises a PLTP promoter operably linked to a WUS gene fused to a T2A viral peptide BBM gene fusion. In a further aspect, the morphogenic gene expression cassette comprises a PLTP promoter operably linked to a WUS gene fused to a T2A viral peptide RepA gene fusion. In a further aspect, the morphogenic gene expression cassette comprises a PLTP promoter operably linked to a WUS gene and a PLTP promoter operably linked to a PKLamiRNA fusion. In a further aspect, a plant seed containing the trait gene expression cassette is provided.

BRIEF DESCRIPTION OF THE FIGURES

FIG. 1 shows the efficiency of somatic embryo formation of plasmids PHP81718 (WUS Treatment) and PHP80728 (TAG-RFP Treatment) as further described in Example 11.

DETAILED DESCRIPTION

The disclosures herein will be described more fully hereinafter with reference to the accompanying figures, in which some, but not all possible aspects are shown. Indeed, disclosures may be embodied in many different forms and should not be construed as limited to the aspects set forth herein; rather, these aspects are provided so that this disclosure will satisfy applicable legal requirements.

Many modifications and other aspects disclosed herein will come to mind to one skilled in the art to which the disclosed methods pertain having the benefit of the teachings presented in the following descriptions and the associated figures. Therefore, it is to be understood that the disclosures are not to be limited to the specific aspects disclosed and that modifications and other aspects are intended to be included within the scope of the appended claims. Although specific terms are employed herein, they are used in a generic and descriptive sense only and not for purposes of limitation.

The terminology used herein is for the purpose of describing particular aspects only and is not intended to be limiting. As used in the specification and in the claims, the term "comprising" can include the aspect of "consisting of." Unless defined otherwise, all technical and scientific terms used herein have the same meaning as commonly understood by one of ordinary skill in the art to which the disclosed methods belong. In this specification and in the claims which follow, reference will be made to a number of terms which shall be defined herein.

The present disclosure comprises methods for producing a transgenic plant using a morphogenic gene. As used herein, the term "morphogenic gene" means a gene that when ectopically expressed stimulates formation of a somatically-derived structure that can produce a plant. More precisely, ectopic expression of the morphogenic gene stimulates the de novo formation of a somatic embryo or an organogenic structure, such as a shoot meristem, that can produce a plant. This stimulated de novo formation occurs either in the cell in which the morphogenic gene is expressed, or in a neighboring cell. A morphogenic gene can be a transcription factor that regulates expression of other genes, or a gene that influences hormone levels in a plant tissue, both of which can stimulate morphogenic changes. As used herein, the term "morphogenic factor" means a morphogenic gene and/or the protein expressed by a morphogenic gene.

A morphogenic gene is involved in plant metabolism, organ development, stem cell development, cell growth stimulation, organogenesis, somatic embryogenesis initiation, accelerated somatic embryo maturation, initiation and/or development of the apical meristem, initiation and/or development of shoot meristem, or a combination thereof, such as WUS/WOX genes (WUS1, WUS2, WUS3, WOX2A, WOX4, WOX5, or WOX9) see, U.S. Pat. Nos.

7,348,468 and 7,256,322 and US Patent Application Publication Numbers 2017/0121722 and 2007/0271628, herein incorporated by reference in their entirety; Laux et al. (1996) Development 122:87-96; and Mayer et al. (1998) Cell 95:805-815; van der Graaff et al., 2009, Genome Biology 10:248; Dolzblasz et al., 2016, Mol. Plant 19:1028-39. Modulation of WUS/WOX is expected to modulate plant and/or plant tissue phenotype including plant metabolism, organ development, stem cell development, cell growth stimulation, organogenesis, somatic embryogenesis initiation, accelerated somatic embryo maturation, initiation and/or development of the apical meristem, initiation and/or development of shoot meristem, or a combination thereof. Expression of *Arabidopsis* WUS can induce stem cells in vegetative tissues, which can differentiate into somatic embryos (Zuo, et al. (2002) Plant J 30:349-359). Also of interest in this regard would be a MYB118 gene (see U.S. Pat. No. 7,148,402), MYB115 gene (see Wang et al. (2008) Cell Research 224-235), a BABYBOOM gene (BBM; see Boutilier et al. (2002) Plant Cell 14:1737-1749), or a CLAVATA gene (see, for example, U.S. Pat. No. 7,179,963).

Morphogenic polynucleotide sequences and amino acid sequences of WUS/WOX homeobox polypeptides are useful in the disclosed methods. The Wuschel protein, designated hereafter as WUS, plays a key role in the initiation and maintenance of the apical meristem, which contains a pool of pluripotent stem cells (Endrizzi, et al., (1996) Plant Journal 10:967-979; Laux, et al., (1996) Development 122:87-96; and Mayer, et al., (1998) Cell 95:805-815). *Arabidopsis* plants mutant for the WUS gene contain stem cells that are misspecified and that appear to undergo differentiation. WUS encodes a novel homeodomain protein which presumably functions as a transcriptional regulator (Mayer, et al., (1998) Cell 95:805-815). The stem cell population of *Arabidopsis* shoot meristems is believed to be maintained by a regulatory loop between the CLAVATA (CLV) genes which promote organ initiation and the WUS gene which is required for stem cell identity, with the CLV genes repressing WUS at the transcript level, and WUS expression being sufficient to induce meristem cell identity and the expression of the stem cell marker CLV3 (Brand, et al., (2000) Science 289:617-619; Schoof, et al., (2000) Cell 100:635-644). Constitutive expression of WUS in *Arabidopsis* has been shown to lead to adventitious shoot proliferation from leaves (in planta) (Laux, T., Talk Presented at the XVI International Botanical Congress Meeting, Aug. 1-7, 1999, St. Louis, Mo.).

In an aspect, the WUS/WOX homeobox polypeptide useful in the methods of the disclosure is a WUS1, WUS2, WUS3, WOX2A, WOX4, WOX5, WOX5A, or WOX9 polypeptide (see, U.S. Pat. Nos. 7,348,468 and 7,256,322 and US Patent Application Publication Numbers 2017/0121722 and 2007/0271628, herein incorporated by reference in their entirety and van der Graaff et al., 2009, Genome Biology 10:248). The WUS/WOX homeobox polypeptide useful in the methods of the disclosure can be obtained from or derived from any of the plants described herein. Additional WUS/WOX genes useful in the methods of the disclosure are listed in Table 1 below.

TABLE 1

| SEQ ID NO: | Polynucleotide (DNA) or Polypeptide (PRT) | Name | Description |
|---|---|---|---|
| 1 | DNA | AT-WUS | *Arabidopsis thaliana* WUS coding sequence |
| 2 | PRT | AT-WUS | *Arabidopsis thaliana* WUS protein sequence |
| 3 | DNA | LJ-WUS | *Lotus japonicus* WUS coding sequence |
| 4 | PRT | LJ-WUS | *Lotus japonicus* WUS protein sequence |
| 5 | DNA | GM-WUS | *Glycine max* WUS coding sequence |
| 6 | PRT | GM-WUS | *Glycine max* WUS protein sequence |
| 7 | DNA | CS-WUS | *Camelina sativa* WUS coding sequence |
| 8 | PRT | CS-WUS | *Camelina sativa* WUS protein sequence |
| 9 | DNA | CR-WUS | *Capsella rubella* WUS coding sequence |
| 10 | PRT | CR-WUS | *Capsella rubella* WUS protein sequence |
| 11 | DNA | AA-WUS | *Arabis alpina* WUS coding sequence |
| 12 | PRT | AA-WUS | *Arabis alpina* WUS protein sequence |
| 13 | DNA | RS-WUS | *Raphanus sativus* WUS coding sequence |
| 14 | PRT | RS-WUS | *Raphanus sativus* WUS protein sequence |
| 15 | DNA | BN-WUS | *Brassica napus* WUS coding sequence |
| 16 | PRT | BN-WUS | *Brassica napus* WUS protein sequence |
| 17 | DNA | BO-WUS | *Brassica oleracea* var. *oleracea* WUS coding sequence |
| 18 | PRT | BO-WUS | *Brassica oleracea* var. *oleracea* WUS protein sequence |
| 19 | DNA | HA-WUS | *Helianthus annuus* WUS coding sequence |
| 20 | PRT | HA-WUS | *Helianthus annuus* WUS protein sequence |
| 21 | DNA | PT-WUS | *Populus trichocarpa* WUS coding sequence |
| 22 | PRT | PT-WUS | *Populus trichocarpa* WUS protein sequence |
| 23 | DNA | VV-WUS | *Vitus vinifera* WUS coding sequence |
| 24 | PRT | VV-WUS | *Vitus vinifera* WUS protein sequence |
| 25 | DNA | AT-WUS | *Arabidopsis thaliana* WUS coding sequence (soy optimized) |
| 26 | PRT | AT-WUS | *Arabidopsis thaliana* WUS protein sequence |
| 27 | DNA | LJ-WUS | *Lotus japonicus* WUS coding sequence (soy optimized) |
| 28 | PRT | LJ-WUS | *Lotus japonicus* WUS protein sequence |
| 29 | DNA | MT-WUS | *Medicago trunculata* WUS coding sequence (soy optimized) |
| 30 | PRT | MT-WUS | *Medicago trunculata* WUS protein sequence |
| 31 | DNA | PY-WUS | *Petunia hybrida* WUS coding sequence (soy optimized) |
| 32 | PRT | PY-WUS | *Petunia hybrida* WUS protein sequence |
| 33 | DNA | PV-WUS | *Phaseolus vulgaris* WUS coding sequence (soy optimized) |
| 34 | PRT | PV-WUS | *Phaseolus vulgaris* WUS protein sequence |

Other morphogenic genes useful in the present disclosure include, but are not limited to, LEC1 (U.S. Pat. No. 6,825,397 incorporated herein by reference in its entirety, Lotan et al., 1998, Cell 93:1195-1205), LEC2 (Stone et al., 2008, PNAS 105:3151-3156; Belide et al., 2013, Plant Cell Tiss. Organ Cult 113:543-553), KN1/STM (Sinha et al., 1993. Genes Dev 7:787-795), the IPT gene from *Agrobacterium* (Ebinuma and Komamine, 2001, In vitro Cell. Dev Biol-Plant 37:103-113), MONOPTEROS-DELTA (Ckurshumova et al., 2014, New Phytol. 204:556-566), the *Agrobacterium* AV-6b gene (Wabiko and Minemura 1996, Plant Physiol. 112:939-951), the combination of the *Agrobacterium* IAA-h and IAA-m genes (Endo et al., 2002, Plant Cell Rep., 20:923-928), the *Arabidopsis* SERK gene (Hecht et al., 2001, Plant Physiol. 127:803-816), the Arabiopsis AGL15 gene (Harding et al., 2003, Plant Physiol. 133:653-663), the FUSCA gene (Castle and Meinke, Plant Cell 6:25-41), and the PICKLE gene (Ogas et al., 1999, PNAS 96:13839-13844).

As used herein, the term "expression cassette" means a distinct component of vector DNA consisting of coding and non-coding sequences including 5' and 3' regulatory sequences that control expression in a transformed/transfected cell.

As used herein, the term "coding sequence" means the portion of DNA sequence bounded by a start and a stop codon that encodes the amino acids of a protein.

As used herein, the term "non-coding sequence" means the portions of a DNA sequence that are transcribed to produce a messenger RNA, but that do not encode the amino acids of a protein, such as 5' untranslated regions, introns and 3' untranslated regions. Non-coding sequence can also refer to RNA molecules such as micro-RNAs, interfering RNA or RNA hairpins, that when expressed can down-regulate expression of an endogenous gene or another transgene.

As used herein, the term "regulatory sequence" means a segment of a nucleic acid molecule which is capable of increasing or decreasing the expression of a gene. Regulatory sequences include promoters, terminators, enhancer elements, silencing elements, 5' UTR and 3' UTR (untranslated region).

As used herein, the term "Agro1" means an *Agrobacterium* harboring a plasmid with a T-DNA containing a "trait gene" expression cassette.

As used herein, the term "Agro2" means an *Agrobacterium* harboring a plasmid with a T-DNA containing a "morphogenic gene" expression cassette, expressing genes such as, but not limited to, BBM and/or WUS2.

As used herein, the term "transfer cassette" means a T-DNA comprising an expression cassette or expression cassettes flanked by the right border and the left border.

As used herein, T-DNA means a portion of a Ti plasmid that is inserted into the genome of a host plant cell.

As used herein, the term "selectable marker" means a transgene that when expressed in a transformed/transfected cell confers resistance to selective agents such as antibiotics, herbicides and other compounds toxic to an untransformed/untransfected cell.

As used herein, the term "EAR" means an Ethylene-responsive element binding factor-associated Amphiphilic Repression motif" with a general consensus sequence of LLxLxL, DNLxxP, LxLxPP, R/KLFGV, or TLLLFR that act as transcriptional repression signals within transcription factors. Addition of an EAR-type repressor element to a DNA-binding protein such as a transcription factor, dCAS9, or LEXA (as examples) confers transcriptional repression function to the fusion protein (Kagale, S., and Rozwadowski, K. 2010. Plant Signaling and Behavior 5:691-694).

As used herein, the term "transcription factor" means a protein that controls the rate of transcription of specific genes by binding to the DNA sequence of the promoter and either up-regulating or down-regulating expression. Examples of transcription factors, which are also morphogenic genes, include members of the AP2/EREBP family (including the BBM (ODP2), plethora and aintegumenta sub-families, CAAT-box binding proteins such as LEC1 and HAP3, and members of the MYB, bHLH, NAC, MADS, bZIP and WRKY families.

Morphogenic polynucleotide sequences and amino acid sequences of Ovule Development Protein 2 (ODP2) polypeptides, and related polypeptides, e.g., Babyboom (BBM) protein family proteins are useful in the methods of the disclosure. In an aspect, a polypeptide comprising two AP2-DNA binding domains is an ODP2, BBM2, BMN2, or BMN3 polypeptide see, US Patent Application Publication Number 2017/0121722, herein incorporated by reference in its entirety. ODP2 polypeptides useful in the methods of the disclosure contain two predicted APETALA2 (AP2) domains and are members of the AP2 protein family (PFAM Accession PF00847). The AP2 family of putative transcription factors has been shown to regulate a wide range of developmental processes, and the family members are characterized by the presence of an AP2 DNA binding domain. This conserved core is predicted to form an amphipathic alpha helix that binds DNA. The AP2 domain was first identified in APETALA2, an *Arabidopsis* protein that regulates meristem identity, floral organ specification, seed coat development, and floral homeotic gene expression. The AP2 domain has now been found in a variety of proteins.

ODP2 polypeptides useful in the methods of the disclosure share homology with several polypeptides within the AP2 family, e.g., see FIG. 1 of U.S. Pat. No. 8,420,893, which is incorporated herein by reference in its entirety, provides an alignment of the maize and rice ODP2 polypeptides with eight other proteins having two AP2 domains. A consensus sequence of all proteins appearing in the alignment of U.S. Pat. No. 8,420,893 is also provided in FIG. 1 therein. The polypeptide comprising the two AP2-DNA binding domains useful in the methods of the disclosure can be obtained from or derived from any of the plants described herein. In an aspect, the polypeptide comprising the two AP2-DNA binding domains useful in the methods of the disclosure is an ODP2 polypeptide. In an aspect, the polypeptide comprising the two AP2-DNA binding domains useful in the methods of the disclosure is a BBM2 polypeptide. The ODP2 polypeptide and the BBM2 polypeptide useful in the methods of the disclosure can be obtained from or derived from any of the plants described herein.

A morphogenic gene may be stably incorporated into the genome of a plant or it may be transiently expressed. In an aspect, expression of the morphogenic gene is controlled. The controlled expression may be a pulsed expression of the morphogenic gene for a particular period of time. Alternatively, the morphogenic gene may be expressed in only some transformed cells and not expressed in others. The control of expression of the morphogenic gene can be achieved by a variety of methods as disclosed herein below. The morphogenic genes useful in the methods of the disclosure may be obtained from or derived from any plant species described herein.

The term "plant" refers to whole plants, plant organs (e.g., leaves, stems, roots, etc.), plant tissues, plant cells, plant parts, seeds, propagules, embryos and progeny of the same. Plant cells can be differentiated or undifferentiated (e.g. callus, undifferentiated callus, immature and mature embryos, immature zygotic embryo, immature cotyledon, embryonic axis, suspension culture cells, protoplasts, leaf, leaf cells, root cells, phloem cells and pollen). Plant cells include, without limitation, cells from seeds, suspension cultures, explants, immature embryos, embryos, zygotic embryos, somatic embryos, embryogenic callus, meristem, somatic meristems, organogenic callus, protoplasts, embryos derived from mature ear-derived seed, leaf bases, leaves from mature plants, leaf tips, immature influorescences, tassel, immature ear, silks, cotyledons, immature cotyledons, embryonic axes, meristematic regions, callus tissue, cells from leaves, cells from stems, cells from roots, cells from shoots, gametophytes, sporophytes, pollen and microspores. Plant parts include differentiated and undifferentiated tissues including, but not limited to, roots, stems, shoots, leaves, pollen, seeds, tumor tissue and various forms of cells in culture (e. g., single cells, protoplasts, embryos, and callus tissue). The plant tissue may be in a plant or in a plant organ, tissue, or cell culture. Grain is intended to mean the mature seed produced by commercial growers for purposes other than growing or reproducing the species. Progeny, variants and mutants of the regenerated plants are also included within the scope of the disclosure, provided these progeny, variants and mutants comprise the introduced polynucleotides.

The present disclosure may be used for transformation of any plant species, including, but not limited to, monocots and dicots. Monocots include, but are not limited to, barley, maize (corn), millet (e.g., pearl millet (*Pennisetum glaucum*), proso millet (*Panicum miliaceum*), foxtail millet (*Setaria italica*), finger millet (*Eleusine coracana*), teff (*Eragrostis tef*), oats, rice, rye, *Setaria* sp., *sorghum*, triticale, or wheat, or leaf and stem crops, including, but not limited to, bamboo, marram grass, meadow-grass, reeds, ryegrass, sugarcane; lawn grasses, ornamental grasses, and other grasses such as switchgrass and turf grass. Alternatively, dicot plants used in the present disclosure, include, but are not limited to, kale, cauliflower, broccoli, mustard plant, cabbage, pea, clover, alfalfa, broad bean, tomato, peanut, cassava, soybean, canola, alfalfa, sunflower, safflower, tobacco, *Arabidopsis*, or cotton.

Examples of plant species of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), *sorghum* (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), *macadamia* (*Macadamia integrifolia*), almond (*Prunus amygdalus*), sugar beets (*Beta vulgaris*), sugarcane (*Saccharum* spp.), oats, barley, vegetables, ornamentals, and conifers.

Higher plants, e.g., classes of Angiospermae and Gymnospermae may be used the present disclosure. Plants of suitable species useful in the present disclosure may come from the family Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, and Vitaceae. Plants from members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis*, and *Zea* may be used in the methods of the disclosure.

Plants important or interesting for agriculture, horticulture, biomass production (for production of liquid fuel molecules and other chemicals), and/or forestry may be used in the methods of the disclosure. Non-limiting examples include, for instance, *Panicum virgatum* (switchgrass), *Miscanthus giganteus* (*miscanthus*), *Saccharum* spp. (sugarcane, energycane), *Populus balsamifera* (poplar), cotton (*Gossypium barbadense, Gossypium hirsutum*), *Helianthus annuus* (sunflower), *Medicago sativa* (alfalfa), *Beta vulgaris* (sugarbeet), *sorghum* (*Sorghum bicolor, Sorghum vulgare*), *Erianthus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Arundo donax* (giant reed), *Secale cereale* (rye), Salix spp. (willow), *Eucalyptus* spp. (*eucalyptus*, including *E. grandis* (and its hybrids, known as "urograndis"), *E. globulus, E. camaldulensis, E. tereticornis, E. viminalis, E. nitens, E. saligna* and *E. urophylla*), *Triticosecale* spp. (*triticum*–wheat×rye), teff (*Eragrostis tef*), Bamboo, *Carthamus tinctorius* (safflower), *Jatropha curcas* (*jatropha*), *Ricinus communis* (castor), *Elaeis guineensis* (palm), *Linum usitatissimum* (flax), *Manihot esculenta* (cassava), *Lycopersicon esculentum* (tomato), *Lactuca sativa* (lettuce), *Phaseolus vulgaris* (green beans), *Phaseolus limensis* (lima beans), *Lathyrus* spp. (peas), *Musa paradisiaca* (banana), *Solanum tuberosum* (potato), *Brassica* spp. (*B. napus* (canola), *B. rapa, B. juncea*), *Brassica oleracea* (broccoli, cauliflower, brussel sprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Arachis hypogaea* (peanuts), *Ipomoea batatus* (sweet potato), *Cocos nucifera* (coconut), *Citrus* spp. (citrus trees), *Persea americana* (avocado), fig (*Ficus casica*), guava (*Psidium guajava*), mango (*Mangifera indica*), olive (*Olea europaea*), *Carica papaya* (papaya), *Anacardium occidentale* (cashew), *Macadamia integrifolia* (*macadamia* tree), *Prunus amygdalus* (almond), *Allium cepa*

(onion), *Cucumis melo* (musk melon), *Cucumis sativus* (cucumber), *Cucumis cantalupensis* (cantaloupe), *Cucurbita maxima* (squash), *Cucurbita moschata* (squash), *Spinacea oleracea* (spinach), *Citrullus lanatus* (watermelon), *Abelmoschus esculentus* (okra), *Solanum melongena* (eggplant), *Cyamopsis tetragonoloba* (guar bean), *Ceratonia siliqua* (locust bean), *Trigonella foenum-graecum* (fenugreek), *Vigna radiata* (mung bean), *Vigna unguiculata* (cowpea), *Vicia faba* (fava bean), *Cicer arietinum* (chickpea), *Lens culinaris* (lentil), *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica., Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii, Tanacetum parthenium, Parthenium argentatum* (guayule), *Hevea* spp. (rubber), *Mentha spicata* (mint), *Mentha piperita* (mint), *Bixa orellana* (achiote), *Alstroemeria* spp., *Rosa* spp. (rose), *Rhododendron* spp. (azalea), *Macrophylla hydrangea* (*hydrangea*), *Hibiscus rosasanensis* (*hibiscus*), *Tulipa* spp. (tulips), *Narcissus* spp. (daffodils), *Petunia hybrida* (petunias), *Dianthus caryophyllus* (carnation), *Euphorbia pulcherrima* (poinsettia), *chrysanthemum, Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass), *Phleum pratense* (timothy), and conifers.

Conifers may be used in the present disclosure and include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Eastern or Canadian hemlock (*Tsuga canadensis*); Western hemlock (*Tsuga heterophylla*); Mountain hemlock (*Tsuga mertensiana*); Tamarack or Larch (*Larix occidentalis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*).

Turf grasses may be used in the present disclosure and include, but are not limited to: annual bluegrass (*Poa annua*); annual ryegrass (*Lolium multiflorum*); Canada bluegrass (*Poa compressa*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); timothy (*Phleum pratense*); velvet bentgrass (*Agrostis canina*); weeping alkaligrass (*Puccinellia distans*); western wheatgrass (*Agropyron smithii*); St. Augustine grass (*Stenotaphrum secundatum*); *zoysia* grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore *paspalum* (*Paspalum vaginatum*); blue gramma (*Bouteloua gracilis*); buffalo grass (*Buchloe dactyloids*); sideoats gramma (*Bouteloua curtipendula*).

In specific aspects, plants transformed by the methods of the present disclosure are crop plants (for example, corn, alfalfa, sunflower, *Brassica*, soybean, cotton, safflower, peanut, rice. *sorghum*, wheat, millet, tobacco, etc.). Plants of particular interest include grain plants that provide seeds of interest, oil-seed plants, and leguminous plants. Seeds of interest include grain seeds, such as corn, wheat, barley, rice, *sorghum*, rye, etc. Oil-seed plants include cotton, soybean, safflower, sunflower, *Brassica*, maize, alfalfa, palm, coconut, etc. Leguminous plants include, but are not limited to, beans and peas. Beans include, but are not limited to, guar, locust bean, fenugreek, soybean, garden beans, cowpea, mungbean, lima bean, fava bean, lentils, and chickpea.

The present disclosure also includes plants obtained by any of the disclosed methods herein. The present disclosure also includes seeds from a plant obtained by any of the disclosed methods herein. A transgenic plant is defined as a mature, fertile plant that contains a transgene.

In the disclosed methods, various plant-derived explants can be used, including immature embryos, 1-5 mm zygotic embryos, 3-5 mm embryos, and embryos derived from mature ear-derived seed, leaf bases, leaves from mature plants, leaf tips, immature influorescences, tassel, immature ear, and silks. In an aspect, the explants used in the disclosed methods can be derived from mature ear-derived seed, leaf bases, leaves from mature plants, leaf tips, immature influorescences, tassel, immature ear, and silks. The explant used in the disclosed methods can be derived from any of the plants described herein.

The disclosure encompasses isolated or substantially purified nucleic acid compositions. An "isolated" or "purified" nucleic acid molecule or protein or a biologically active portion thereof is substantially free of other cellular material or components that normally accompany or interact with the nucleic acid molecule or protein as found in its naturally occurring environment or is substantially free of culture medium when produced by recombinant techniques or substantially free of chemical precursors or other chemicals when chemically synthesized. An "isolated" nucleic acid is substantially free of sequences (including protein encoding sequences) that naturally flank the nucleic acid (i.e., sequences located at the 5' and 3' ends of the nucleic acid) in the genomic DNA of the organism from which the nucleic acid is derived. For example, in various aspects, an isolated nucleic acid molecule can contain less than about 5 kb, 4 kb, 3 kb, 2 kb, 1 kb, 0.5 kb or 0.1 kb of nucleotide sequences that naturally flank the nucleic acid molecule in genomic DNA of the cell from which the nucleic acid is derived. A protein that is substantially free of cellular material includes preparations of protein having less than about 30%, 20%, 10%, 5%, or 1% (by dry weight) of contaminating protein. When a protein useful in the methods of the disclosure or biologically active portion thereof is recombinantly produced, optimally culture medium represents less than about 30%, 20%, 10%, 5%, or 1% (by dry weight) of chemical precursors or non-protein-of-interest chemicals. Sequences useful in the methods of the disclosure may be isolated from the 5' untranslated region flanking their respective transcription initiation sites. The present disclosure encompasses isolated or substantially purified nucleic acid or protein compositions useful in the methods of the disclosure.

As used herein, the term "fragment" refers to a portion of the nucleic acid sequence. Fragments of sequences useful in the methods of the disclosure retain the biological activity of the nucleic acid sequence. Alternatively, fragments of a nucleotide sequence that are useful as hybridization probes may not necessarily retain biological activity. Fragments of a nucleotide sequence disclosed herein may range from at least about 20, 25, 50, 75, 100, 125, 150, 175, 200, 225, 250, 275, 300, 325, 350, 375, 400, 425, 450, 475, 500, 525, 550, 575, 600, 625, 650, 675, 700, 725, 750, 775, 800, 825, 850, 875, 900, 925, 950, 975, 1000, 1025, 1050, 1075, 1100, 1125, 1150, 1175, 1200, 1225, 1250, 1275, 1300, 1325, 1350, 1375, 1400, 1425, 1450, 1475, 1500, 1525, 1550, 1575, 1600, 1625, 1650, 1675, 1700, 1725, 1750, 1775, 1800, 1825, 1850, 1875, 1900, 1925, 1950, 1975, 2000, 2025, 2050, 2075, 2100, 2125, 2150, 2175, 2200, 2225, 2250, 2275, 2300, 2325, 2350, 2375, 2400, 2425, 2450, 2475, 2500, 2525, 2550, 2575, 2600, 2625, 2650, 2675, 2700, 2725, 2750, 2775, 2800, 2825, 2850, 2875, 2900, 2925, 2950, 2975, 3000, 3025, 3050, 3075, 3100, 3125, 3150, 3175, 3200, 3225, 3250, 3275, 3300, 3325, 3350, 3375, 3400, 3425, 3450, 3475, 3500, 3525, 3550, 3575, 3600, 3625, 3650, 3675, 3700, 3725, 3750, 3775, 3800, 3825, 3850, 3875, 3900, 3925, 3950, 3975, 4000, 4025, 4050, 4075, 4100, 4125, 4150, 4175, 4200, 4225, 4250, 4275, 4300, 4325, 4350, 4375, 4400, 4425, 4450, 4475, 4500, 4525, 4550, 4575, 4600, 4625, 4650, 4675, 4700, 4725, 4750, 4775, 4800, 4825, 4850, 4875, 4900, 4925, 4950, 4975, 5000, 5025, 5050, 5075, 5100, 5125, 5150, 5175, 5200, 5225, 5250, 5275, 5300, 5325, 5350, 5375, 5400, 5425, 5450, 5475, 5500, 5525, 5550, 5575, 5600, 5625, 5650, 5675, 5700, 5725, 5750, 5775, 5800, 5825, 5850, 5875, 5900, 5925, 5950, 5975, 6000, 6025, 6050, 6075, 6100, 6125, 6150, 6175, 6200, or 6225 nucleotides, and up to the full length of the subject sequence. A biologically active portion of a nucleotide sequence can be prepared by isolating a portion of the sequence, and assessing the activity of the portion.

Fragments and variants of nucleotide sequences and the proteins encoded thereby useful in the methods of the present disclosure are also encompassed. As used herein, the term “fragment” refers to a portion of a nucleotide sequence and hence the protein encoded thereby or a portion of an amino acid sequence. Fragments of a nucleotide sequence may encode protein fragments that retain the biological activity of the native protein. Alternatively, fragments of a nucleotide sequence useful as hybridization probes generally do not encode fragment proteins retaining biological activity. Thus, fragments of a nucleotide sequence may range from at least about 20 nucleotides, about 50 nucleotides, about 100 nucleotides, and up to the full-length nucleotide sequence encoding the proteins useful in the methods of the disclosure.

As used herein, the term “variants” is means sequences having substantial similarity with a sequence disclosed herein. A variant comprises a deletion and/or addition of one or more nucleotides or peptides at one or more internal sites within the native polynucleotide or polypeptide and/or a substitution of one or more nucleotides or peptides at one or more sites in the native polynucleotide or polypeptide. As used herein, a “native” nucleotide or peptide sequence comprises a naturally occurring nucleotide or peptide sequence, respectively. For nucleotide sequences, naturally occurring variants can be identified with the use of well-known molecular biology techniques, such as, for example, with polymerase chain reaction (PCR) and hybridization techniques as outlined herein. A biologically active variant of a protein useful in the methods of the disclosure may differ from that native protein by as few as 1-15 amino acid residues, as few as 1-10, such as 6-10, as few as 5, as few as 4, 3, 2, or even 1 amino acid residue.

Variant nucleotide sequences also include synthetically derived nucleotide sequences, such as those generated, for example, by using site-directed mutagenesis. Generally, variants of a nucleotide sequence disclosed herein will have at least 40%, 50%, 60%, 65%, 70%, 75%, 80%, 85%, 90%, 91%, 92%, 93%, 94%, to 95%, 96%, 97%, 98%, 99% or more sequence identity to that nucleotide sequence as determined by sequence alignment programs described elsewhere herein using default parameters. Biologically active variants of a nucleotide sequence disclosed herein are also encompassed. Biological activity may be measured by using techniques such as Northern blot analysis, reporter activity measurements taken from transcriptional fusions, and the like. See, for example, Sambrook, et al., (1989) Molecular Cloning: A Laboratory Manual (2d ed., Cold Spring Harbor Laboratory Press, Cold Spring Harbor, N.Y.), hereinafter “Sambrook,” herein incorporated by reference in its entirety. Alternatively, levels of a reporter gene such as green fluorescent protein (GFP) or yellow fluorescent protein (YFP) or the like produced under the control of a promoter operably linked to a nucleotide fragment or variant can be measured. See, for example, Matz et al. (1999) Nature Biotechnology 17:969-973; U.S. Pat. No. 6,072,050, herein incorporated by reference in its entirety; Nagai, et al., (2002) Nature Biotechnology 20(1):87-90. Variant nucleotide sequences also encompass sequences derived from a mutagenic and recombinogenic procedure such as DNA shuffling. With such a procedure, one or more different nucleotide sequences can be manipulated to create a new nucleotide sequence. In this manner, libraries of recombinant polynucleotides are generated from a population of related sequence polynucleotides comprising sequence regions that have substantial sequence identity and can be homologously recombined in vitro or in vivo. Strategies for such DNA shuffling are known in the art. See, for example, Stemmer, (1994) Proc. Natl. Acad. Sci. USA 91:10747-10751; Stemmer, (1994) Nature 370:389 391; Crameri, et al., (1997) Nature Biotech. 15:436-438; Moore, et al., (1997) J. Mol. Biol. 272:336-347; Zhang, et al., (1997) Proc. Natl. Acad. Sci. USA 94:4504-4509; Crameri, et al., (1998) Nature 391:288-291 and U.S. Pat. Nos. 5,605,793 and 5,837,458, herein incorporated by reference in their entirety.

Methods for mutagenesis and nucleotide sequence alterations are well known in the art. See, for example, Kunkel, (1985) Proc. Natl. Acad. Sci. USA 82:488-492; Kunkel, et al., (1987) Methods in Enzymol. 154:367-382; U.S. Pat. No. 4,873,192; Walker and Gaastra, eds. (1983) Techniques in Molecular Biology (MacMillan Publishing Company, New York) and the references cited therein, herein incorporated by reference in their entirety. Guidance as to appropriate amino acid substitutions that do not affect biological activity of the protein of interest may be found in the model of Dayhoff et al. (1978) Atlas of Protein Sequence and Structure (Natl. Biomed. Res. Found., Washington, D.C.), herein incorporated by reference. Conservative substitutions, such as exchanging one amino acid with another having similar properties, may be optimal.

The nucleotide sequences of the disclosure can be used to isolate corresponding sequences from other organisms, particularly other plants, more particularly other monocots or dicots. In this manner, methods such as PCR, hybridization and the like can be used to identify such sequences based on their sequence homology to the sequences set forth herein. Sequences isolated based on their sequence identity to the entire sequences set forth herein or to fragments thereof are encompassed by the present disclosure.

In a PCR approach, oligonucleotide primers can be designed for use in PCR reactions to amplify corresponding DNA sequences from cDNA or genomic DNA extracted from any plant of interest. Methods for designing PCR primers and PCR cloning are generally known in the art and are disclosed in, Sambrook, supra. See also, Innis, et al., eds. (1990) PCR Protocols: A Guide to Methods and Applications (Academic Press, New York); Innis and Gelfand, eds. (1995) PCR Strategies (Academic Press, New York); and Innis and Gelfand, eds. (1999) PCR Methods Manual (Academic Press, New York), herein incorporated by reference in their entirety. Known methods of PCR include, but are not limited to, methods using paired primers, nested primers, single specific primers, degenerate primers, gene-specific primers, vector-specific primers, partially-mismatched primers and the like.

In hybridization techniques, all or part of a known nucleotide sequence is used as a probe that selectively hybridizes to other corresponding nucleotide sequences present in a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides and may be labeled with a detectable group such as 32P or any other detectable marker. Thus, for example, probes for hybridization can be made by labeling synthetic oligonucleotides based on the sequences of the disclosure. Methods for preparation of probes for hybridization and for construction of genomic libraries are generally known in the art and are disclosed in Sambrook, supra.

For example, an entire sequence disclosed herein, or one or more portions thereof, may be used as a probe capable of specifically hybridizing to corresponding sequences and messenger RNAs. To achieve specific hybridization under a variety of conditions, such probes include sequences that are unique among sequences and are generally at least about 10 nucleotides in length or at least about 20 nucleotides in length. Such probes may be used to amplify corresponding sequences from a chosen plant by PCR. This technique may be used to isolate additional coding sequences from a desired organism or as a diagnostic assay to determine the presence of coding sequences in an organism. Hybridization techniques include hybridization screening of plated DNA libraries (either plaques or colonies, see, for example, Sambrook, supra).

Hybridization of such sequences may be carried out under stringent conditions. The terms "stringent conditions" or "stringent hybridization conditions" are intended to mean conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, optimally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C. and a wash in 1 times to 2 times SSC (20 times SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C. and a wash in 0.5 times to 1 times SSC at 55 to 60° C. Exemplary high stringency conditions include hybridization in 50% formamide, 1 M NaCl, 1% SDS at 37° C., and a final wash in 0.1 times SSC at 60 to 65° C. for a duration of at least 30 minutes. Duration of hybridization is generally less than about 24 hours, usually about 4 to about 12 hours. The duration of the wash time will be at least a length of time sufficient to reach equilibrium.

Specificity is typically the function of post-hybridization washes, the critical factors being the ionic strength and temperature of the final wash solution. For DNA-DNA hybrids, the thermal melting point (Tm) can be approximated from the equation of Meinkoth and Wahl, (1984) Anal. Biochem 138:267 284: Tm=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching, thus, Tm, hybridization, and/or wash conditions can be adjusted to hybridize to sequences of the desired identity. For example, if sequences with 90% identity are sought, the Tm can be decreased 10° C. Generally, stringent conditions are selected to be about 5° C. lower than the Tm for the specific sequence and its complement at a defined ionic strength and pH. However, severely stringent conditions can utilize a hybridization and/or wash at 1, 2, 3 or 4° C. lower than the Tm; moderately stringent conditions can utilize a hybridization and/or wash at 6, 7, 8, 9 or 10° C. lower than the Tm; low stringency conditions can utilize a hybridization and/or wash at 11, 12, 13, 14, 15 or 20° C. lower than the Tm. Using the equation, hybridization and wash compositions, and desired Tm, those of ordinary skill will understand that variations in the stringency of hybridization and/or wash solutions are inherently described. If the desired degree of mismatching results in a Tm of less than 45° C. (aqueous solution) or 32° C. (formamide solution), it is preferred to increase the SSC concentration so that a higher temperature can be used. An extensive guide to the hybridization of nucleic acids is found in Tijssen, (1993) Laboratory Techniques in Biochemistry and Molecular Biology—Hybridization with Nucleic Acid Probes, Part I, Chapter 2 (Elsevier, New York); and Ausubel, et al., eds. (1995) Current Protocols in Molecular Biology, Chapter 2 (Greene Publishing and Wiley-Interscience, New York), herein incorporated by reference in their entirety. See also, Sambrook supra. Thus, isolated sequences that have activity and which hybridize under stringent conditions to the sequences disclosed herein or to fragments thereof, are encompassed by the present disclosure.

In general, sequences that have activity and hybridize to the sequences disclosed herein will be at least 40% to 50% homologous, about 60%, 70%, 80%, 85%, 90%, 95% to 98% homologous or more with the disclosed sequences. That is, the sequence similarity of sequences may range, sharing at least about 40% to 50%, about 60% to 70%, and about 80%, 85%, 90%, 95% to 98% sequence similarity.

The following terms are used to describe the sequence relationships between two or more nucleic acids or polynucleotides: (a) "reference sequence", (b) "comparison window", (c) "sequence identity", (d) "percentage of sequence identity" and (e) "substantial identity". As used herein, "reference sequence" is a defined sequence used as a basis for sequence comparison. A reference sequence may be a subset or the entirety of a specified sequence; for example, as a segment of a full-length cDNA or gene sequence or the complete cDNA or gene sequence.

As used herein, "comparison window" refers to a contiguous and specified segment of a polynucleotide sequence, wherein the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100 or longer. Those of skill in the art understand that to avoid a high similarity to a reference sequence due to inclusion of gaps in the polynucleotide sequence, a gap penalty is typically introduced and is subtracted from the number of matches. Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller, (1988) CABIOS 4:11-17; the algorithm of Smith, et al., (1981) Adv. Appl. Math. 2:482; the algorithm of Needleman and Wunsch, (1970) J. Mol. Biol. 48:443-453; the algorithm of Pearson and Lipman, (1988) Proc. Natl. Acad. Sci. 85:2444-2448; the algorithm of Karlin and Altschul, (1990) Proc. Natl. Acad. Sci. USA 872:264, modified as in Karlin and Altschul, (1993) Proc. Natl. Acad. Sci. USA 90:5873-5877, herein incorporated by reference in their entirety.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA and TFASTA in the GCG Wisconsin Genetics Software Package®, Version 10 (available from Accelrys Inc., 9685 Scranton Road, San Diego, Calif., USA). Alignments using these programs can be performed using the default parameters. The CLUSTAL program is well described by Higgins, et al., (1988) Gene 73:237-244; Higgins, et al., (1989) CABIOS 5:151-153; Corpet, et al., (1988) Nucleic Acids Res. 16:10881-90; Huang, et al., (1992) CABIOS 8:155-65; and Pearson, et al., (1994) Meth. Mol. Biol. 24:307-331, herein incorporated by reference in their entirety. The ALIGN program is based on the algorithm of Myers and Miller, (1988) supra. A PAM120 weight residue table, a gap length penalty of 12, and a gap penalty of 4 can be used with the ALIGN program when comparing amino acid sequences. The BLAST programs of Altschul, et al., (1990) J. Mol. Biol. 215:403, herein incorporated by reference in its entirety, are based on the algorithm of Karlin and Altschul, (1990) supra. BLAST nucleotide searches can be performed with the BLASTN program, score=100, word length=12, to obtain nucleotide sequences homologous to a nucleotide sequence encoding a protein of the disclosure. BLAST protein searches can be performed with the BLASTX program, score=50, word length=3, to obtain amino acid sequences homologous to a protein or polypeptide of the disclosure. To obtain gapped alignments for comparison purposes, Gapped BLAST (in BLAST 2.0) can be utilized as described in Altschul, et al., (1997) Nucleic Acids Res. 25:3389, herein incorporated by reference in its entirety. Alternatively, PSI-BLAST (in BLAST 2.0) can be used to perform an iterated search that detects distant relationships between molecules. See, Altschul, et al., (1997) supra. When utilizing BLAST, Gapped BLAST, PSI-BLAST, the default parameters of the respective programs (e.g., BLASTN for nucleotide sequences, BLASTX for proteins) can be used. See, the web site for the National Center for Biotechnology Information on the World Wide Web at ncbi.nlm.nih.gov. Alignment may also be performed manually by inspection.

Unless otherwise stated, sequence identity/similarity values provided herein refer to the value obtained using GAP Version 10 using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. As used herein, "equivalent program" is any sequence comparison program that, for any two sequences in question, generates an alignment having identical nucleotide or amino acid residue matches and an identical percent sequence identity when compared to the corresponding alignment generated by GAP Version 10.

The GAP program uses the algorithm of Needleman and Wunsch, supra, to find the alignment of two complete sequences that maximizes the number of matches and minimizes the number of gaps. GAP considers all possible alignments and gap positions and creates the alignment with the largest number of matched bases and the fewest gaps. It allows for the provision of a gap creation penalty and a gap extension penalty in units of matched bases. GAP must make a profit of gap creation penalty number of matches for each gap it inserts. If a gap extension penalty greater than zero is chosen, GAP must, in addition, make a profit for each gap inserted of the length of the gap times the gap extension penalty. Default gap creation penalty values and gap extension penalty values in Version 10 of the GCG Wisconsin Genetics Software Package® for protein sequences are 8 and 2, respectively. For nucleotide sequences the default gap creation penalty is 50 while the default gap extension penalty is 3. The gap creation and gap extension penalties can be expressed as an integer selected from the group of integers consisting of from 0 to 200. Thus, for example, the gap creation and gap extension penalties can be 0, 1, 2, 3, 4, 5, 6, 7, 8, 9, 10, 15, 20, 25, 30, 35, 40, 45, 50, 55, 60, 65 or greater.

GAP presents one member of the family of best alignments. There may be many members of this family, but no other member has a better quality. GAP displays four figures of merit for alignments: Quality, Ratio, Identity and Similarity. The Quality is the metric maximized in order to align the sequences. Ratio is the Quality divided by the number of bases in the shorter segment. Percent Identity is the percent of the symbols that actually match. Percent Similarity is the percent of the symbols that are similar. Symbols that are across from gaps are ignored. A similarity is scored when the scoring matrix value for a pair of symbols is greater than or equal to 0.50, the similarity threshold. The scoring matrix used in Version 10 of the GCG Wisconsin Genetics Software Package® is BLOSUM62 (see, Henikoff and Henikoff, (1989) Proc. Natl. Acad. Sci. USA 89:10915, herein incorporated by reference in its entirety).

As used herein, "sequence identity" or "identity" in the context of two nucleic acid or polypeptide sequences refers to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically, this involves scoring a conservative substitution as a partial rather than a full mismatch, thereby increasing the percentage sequence identity. Thus, for example, where an identical amino acid is given a score of one and a non-conservative substitution is given a score of zero, a conservative substitution is given a score between zero and one. The scoring of conservative substitutions is calculated, e.g., as implemented in the program PC/GENE (Intelligenetics, Mountain View, Calif.).

As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

The term "substantial identity" of polynucleotide sequences means that a polynucleotide comprises a sequence that has at least 70% sequence identity, optimally at least 80%, more optimally at least 90% and most optimally at least 95%, compared to a reference sequence using an alignment program using standard parameters. One of skill in the art will recognize that these values can be appropriately adjusted to determine corresponding identity of proteins encoded by two nucleotide sequences by considering codon degeneracy, amino acid similarity, reading frame positioning and the like. Substantial identity of amino acid sequences for these purposes normally means sequence identity of at least 60%, 70%, 80%, 90% and at least 95%.

Another indication that nucleotide sequences are substantially identical is if two molecules hybridize to each other under stringent conditions. Generally, stringent conditions are selected to be about 5° C. lower than the Tm for the specific sequence at a defined ionic strength and pH. However, stringent conditions encompass temperatures in the range of about 1° C. to about 20° C. lower than the Tm, depending upon the desired degree of stringency as otherwise qualified herein. Nucleic acids that do not hybridize to each other under stringent conditions are still substantially identical if the polypeptides they encode are substantially identical. This may occur, e.g., when a copy of a nucleic acid is created using the maximum codon degeneracy permitted by the genetic code. One indication that two nucleic acid sequences are substantially identical is when the polypeptide encoded by the first nucleic acid is immunologically cross reactive with the polypeptide encoded by the second nucleic acid.

"Variants" is intended to mean substantially similar sequences. For polynucleotides, conservative variants include those sequences that, because of the degeneracy of the genetic code, encode the amino acid sequence of one of the morphogenic genes and/or genes/polynucleotides of interest disclosed herein. Variant polynucleotides also include synthetically derived polynucleotides, such as those generated, for example, by using site-directed mutagenesis but which still encode a protein of a morphogenic gene and/or gene/polynucleotide of interest disclosed herein. Generally, variants of a particular morphogenic gene and/or gene/polynucleotide of interest disclosed herein will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular morphogenic gene and/or gene/polynucleotide of interest as determined by sequence alignment programs and parameters described elsewhere herein.

"Variant" protein is intended to mean a protein derived from the native protein by deletion or addition of one or more amino acids at one or more internal sites in the native protein and/or substitution of one or more amino acids at one or more sites in the native protein. Variant proteins encompassed by the present disclosure are biologically active, that is they continue to possess the desired biological activity of the native protein, that is, the polypeptide has morphogenic gene and/or gene/polynucleotide of interest activity. Such variants may result from, for example, genetic polymorphism or from human manipulation. Biologically active variants of a native morphogenic gene and/or gene/polynucleotide of interest protein disclosed herein will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to the amino acid sequence for the native protein as determined by sequence alignment programs and parameters described elsewhere herein. A biologically active variant of a protein of the disclosure may differ from that protein by as few as 1-15 amino acid residues, as few as 1-10, such as 6-10, as few as 5, as few as 4, 3, 2, or even 1 amino acid residue.

The sequences and genes disclosed herein, as well as variants and fragments thereof, are useful for the genetic engineering of plants, e.g. to produce a transformed or transgenic plant, to express a phenotype of interest. As used herein, the terms "transformed plant" and "transgenic plant" refer to a plant that comprises within its genome a heterologous polynucleotide. Generally, the heterologous polynucleotide is stably integrated within the genome of a transgenic or transformed plant such that the polynucleotide is passed on to successive generations. The heterologous polynucleotide may be integrated into the genome alone or as part of a recombinant DNA construct. It is to be understood that as used herein the term "transgenic" includes any cell, cell line, callus, tissue, plant part or plant the genotype of which has been altered by the presence of a heterologous nucleic acid including those transgenics initially so altered as well as those created by sexual crosses or asexual propagation from the initial transgenic.

A transgenic "event" is produced by transformation of plant cells with a heterologous DNA construct, including a nucleic acid expression cassette that comprises a gene of interest, the regeneration of a population of plants resulting from the insertion of the transferred gene into the genome of the plant and selection of a plant characterized by insertion into a particular genome location. An event is characterized phenotypically by the expression of the inserted gene. At the genetic level, an event is part of the genetic makeup of a plant. The term "event" also refers to progeny produced by a sexual cross between the transformant and another plant wherein the progeny include the heterologous DNA.

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway et al. (1986) Biotechniques 4:320-334), electroporation (Riggs et al. (1986) Proc. Natl. Acad. Sci. USA 83:5602-5606, *Agrobacterium*-mediated transformation (Townsend et al., U.S. Pat. No. 5,563,055; Zhao et al., U.S. Pat. No. 5,981,840), direct gene transfer (Paszkowski et al. (1984) EMBO J. 3:2717-2722), and ballistic particle acceleration (see, for example, Sanford et al., U.S. Pat. No. 4,945,050; Tomes et al., U.S. Pat. No. 5,879,918; Tomes et al., U.S. Pat. No. 5,886,244; Bidney et al., U.S. Pat. No. 5,932,782; Tomes et al. (1995) "Direct DNA Transfer into Intact Plant Cells via Microprojectile Bombardment," in Plant Cell, Tissue, and Organ Culture: Fundamental Methods, ed. Gamborg and Phillips (Springer-Verlag, Berlin) (maize); McCabe et al. (1988) Biotechnology 6:923-926); and Lec1 transformation (WO 00/28058). Also see Weissinger et al. (1988) Ann. Rev. Genet. 22:421-477; Sanford et al. (1987) Particulate Science and Technology 5:27-37 (onion); Christou et al. (1988) Plant Physiol. 87:671-674 (soybean); McCabe et al. (1988) Bio/Technology 6:923-926 (soybean); Finer and McMullen (1991) In Vitro Cell Dev. Biol. 27P: 175-182 (soybean); Singh et al. (1998) Theor. Appl. Genet. 96:319-324 (soybean); Datta et al. (1990) Biotechnology 8:736-740 (rice); Klein et al. (1988) Proc. Natl. Acad. Sci. USA 85:4305-4309 (maize); Klein et al. (1988) Biotechnology 6:559-563 (maize); Tomes, U.S. Pat. No. 5,240,855; Buising et al., U.S. Pat. Nos. 5,322,783 and 5,324,646; Klein et al. (1988) Plant Physiol. 91:440-444 (maize); Fromm et al. (1990) Biotechnology 8:833-839 (maize); Hooykaas-Van Slogteren et al. (1984) Nature (London) 311:763-764; Bowen et al., U.S. Pat. No. 5,736,369 (cereals); Bytebier et al. (1987) Proc. Natl. Acad. Sci. USA 84:5345-5349 (Liliaceae); De Wet et al. (1985) in The Experimental Manipulation of Ovule Tissues, ed. Chapman et al. (Longman, N.Y.), pp. 197-209 (pollen); Kaeppler et al. (1990) Plant Cell Reports 9:415-418 and Kaeppler et al. (1992) Theor. Appl. Genet. 84:560-566 (whisker-mediated transformation); D'Halluin et al. (1992) Plant Cell 4:1495-1505 (electroporation); Li et al. (1993) Plant Cell Reports 12:250-255; Christou and Ford (1995) Annals of Botany 75:407-413 (rice); Osjoda et al. (1996) Nature Biotechnology 14:745-750 (maize via *Agrobacterium tumefaciens*); and US Patent Application Publication Number 2017/0121722 (rapid plant transformation) all of which are herein incorporated by reference in their entireties.

The methods provided herein rely upon the use of bacteria-mediated and/or biolistic-mediated gene transfer to produce regenerable plant cells having an incorporated nucleotide sequence of interest. Bacterial strains useful in the methods of the disclosure include, but are not limited to, a disarmed *Agrobacteria*, an *Ochrobactrum* bacteria or a *Rhizobiaceae* bacteria.

Disarmed *Agrobacteria* useful in the present methods include, but are not limited to, AGL-1, EHA105, GV3101, LBA4404, and LBA4404 THY-.

*Ochrobactrum* bacterial strains useful in the present methods include, but are not limited to, those listed in Table 2.

TABLE 2

| |
|---|
| *Ochrobactrum haywardense* H1 NRRL Deposit B-67078 |
| *Ochrobactrum cytisi* |
| *Ochrobactrum daejeonense* |
| *Ochrobactrum oryzae* |
| *Ochrobactrum tritici* LBNL124-A-10 |
| HTG3-C-07 |
| *Ochrobactrum pecoris* |
| *Ochrobactrum ciceri* |
| *Ochrobactrum gallinifaecis* |
| *Ochrobactrum grignonense* |
| *Ochrobactrum guangzhouense* |
| *Ochrobactrum haematophilum* |
| *Ochrobactrum intermedium* |
| *Ochrobactrum lupini* |
| *Ochrobactrum pituitosum* |
| *Ochrobactrum pseudintermedium* |
| *Ochrobactrum pseudogrignonense* |
| *Ochrobactrum rhizosphaerae* |
| *Ochrobactrum thiophenivorans* |
| *Ochrobactrum tritici* |

*Rhizobiaceae* bacterial strains useful in the present methods include, but are not limited to, those listed in Table 3 (see also U.S. Pat. No. 9,365,859 incorporated herein by reference in its entirety).

TABLE 3

| |
|---|
| *Rhizobium lusitanum* |
| *Rhizobium rhizogenes* |
| *Agrobacterium rubi* |
| *Rhizobium multihospitium* |
| *Rhizobium tropici* |
| *Rhizobium miluonense* |
| *Rhizobium leguminosarum* |
| *Rhizobium leguminosarum* bv. *trifolii* |
| *Rhizobium leguminosarum* bv. *phaseoli* |
| *Rhizobium leguminosarum*. bv. *viciae* |
| *Rhizobium leguminosarum* Madison |
| *Rhizobium leguminosarum* USDA2370 |
| *Rhizobium leguminosarum* USDA2408 |
| *Rhizobium leguminosarum* USDA2668 |
| *Rhizobium leguminosarum* 2370G |
| *Rhizobium leguminosarum* 2370LBA |
| *Rhizobium leguminosarum* 2048G |
| *Rhizobium leguminosarum* 2048LBA |
| *Rhizobium leguminosarum* bv. *phaseoli* 2668G |
| *Rhizobium leguminosarum* bv. *phaseoli* 2668LBA |
| *Rhizobium leguminosarum* RL542C |
| *Rhizobium etli* USDA 9032 |
| *Rhizobium etli* bv. *phaseoli* |
| *Rhizobium endophyticum* |
| *Rhizobium tibeticum* |
| *Rhizobium etli* |
| *Rhizobium pisi* |
| *Rhizobium phaseoli* |
| *Rhizobium fabae* |
| *Rhizobium hainanense* |
| *Arthrobacter viscosus* |
| *Rhizobium alamii* |
| *Rhizobium mesosinicum* |
| *Rhizobium sullae* |
| *Rhizobium indigoferae* |
| *Rhizobium gallicum* |
| *Rhizobium yanglingense* |
| *Rhizobium mongolense* |
| *Rhizobium oryzae* |
| *Rhizobium loessense* |
| *Rhizobium tubonense* |
| *Rhizobium cellulosilyticum* |

TABLE 3-continued

| |
|---|
| *Rhizobium soli* |
| *Neorhizobium galegae* |
| *Neorhizobium vignae* |
| *Neorhizobium huautlense* |
| *Neorhizobium alkalisoli* |
| *Aureimonas altamirensis* |
| *Aureimonas frigidaquae* |
| *Aureimonas ureilytica. Aurantimonas coralicida* |
| *Fulvimarina pelagi* |
| *Martelella mediterranea* |
| *Allorhizobium undicola* |
| *Allorhizobium vitis* |
| *Allorhizobium borbor* |
| *Beijerinckia fluminensis* |
| *Agrobacterium larrymoorei* |
| *Agrobacterium radiobacter* |
| *Rhizobium selenitireducens corrig. Rhizobium rosettiformans* |
| *Rhizobium daejeonense* |
| *Rhizobium aggregatum* |
| *Pararhizobium capsulatum* |
| *Pararhizobium giardinii* |
| *Ensifer mexicanus* |
| *Ensifer terangae* |
| *Ensifer saheli* |
| *Ensifer kostiensis* |
| *Ensifer kummerowiae* |
| *Ensifer fredii* |
| *Sinorhizobium americanum* |
| *Ensifer arboris* |
| *Ensifer garamanticus* |
| *Ensifer meliloti* |
| *Ensifer numidicus* |
| *Ensifer adhaerens* |
| *Sinorhizobium* sp. |
| *Sinorhizobium meliloti* SD630 |
| *Sinorhizobium meliloti* USDA1002 |
| *Sinorhizobium fredii* USDA205 |
| *Sinorhizobium fredii* SF542G |
| *Sinorhizobium fredii* SF4404 |
| *Sinorhizobium fredii* SM542C. |

The polynucleotide of the disclosure may be introduced into plants by contacting plants with a virus or viral nucleic acids. Generally, such methods involve incorporating a nucleotide construct of the disclosure within a viral DNA or RNA molecule. Methods for introducing polynucleotides into plants and expressing a protein encoded therein, involving viral DNA or RNA molecules, are known in the art. See, for example, U.S. Pat. Nos. 5,889,191, 5,889,190, 5,866,785, 5,589,367, 5,316,931 and Porta, et al., (1996) Molecular Biotechnology 5:209-221, herein incorporated by reference in their entirety.

The methods of the disclosure involve introducing a polypeptide or polynucleotide into a plant. As used herein, "introducing" means presenting to the plant the polynucleotide or polypeptide in such a manner that the sequence gains access to the interior of a cell of the plant. The methods of the disclosure do not depend on a particular method for introducing a sequence into a plant, only that the polynucleotide or polypeptides gains access to the interior of at least one cell of the plant. Methods for introducing polynucleotide or polypeptides into plants are known in the art including, but not limited to, stable transformation methods, transient transformation methods and virus-mediated methods.

A "stable transformation" is a transformation in which a nucleotide construct or an expression cassette introduced into a plant integrates into the genome of the plant and is capable of being inherited by the progeny thereof "Transient transformation" means that a polynucleotide or an expression cassette is introduced into the plant and does not integrate into the genome of the plant or that a polypeptide is introduced into a plant.

Reporter genes or selectable marker genes may also be included in the expression cassettes discloses herein and used in the methods of the disclosure. Examples of suitable reporter genes known in the art can be found in, for example, Jefferson, et al., (1991) in Plant Molecular Biology Manual, ed. Gelvin, et al., (Kluwer Academic Publishers), pp. 1-33; DeWet, et al., (1987) Mol. Cell. Biol. 7:725-737; Goff, et al., (1990) EMBO J. 9:2517-2522; Kain, et al., (1995) Bio Techniques 19:650-655 and Chiu, et al., (1996) Current Biology 6:325-330, herein incorporated by reference in their entirety.

A selectable marker comprises a DNA segment that allows one to identify or select for or against a molecule or a cell that contains it, often under particular conditions. These markers can encode an activity, such as, but not limited to, production of RNA, peptide, or protein, or can provide a binding site for RNA, peptides, proteins, inorganic and organic compounds or compositions and the like. Examples of selectable markers include, but are not limited to, DNA segments that comprise restriction enzyme sites; DNA segments that encode products which provide resistance against otherwise toxic compounds (e.g., antibiotics, such as, spectinomycin, ampicillin, kanamycin, tetracycline, Basta, neomycin phosphotransferase II (NEO) and hygromycin phosphotransferase (HPT)); DNA segments that encode products which are otherwise lacking in the recipient cell (e.g., tRNA genes, auxotrophic markers); DNA segments that encode products which can be readily identified (e.g., phenotypic markers such as β-galactosidase, GUS; fluorescent proteins such as green fluorescent protein (GFP), cyan (CFP), yellow (YFP), red (RFP), and cell surface proteins); the generation of new primer sites for PCR (e.g., the juxtaposition of two DNA sequence not previously juxtaposed), the inclusion of DNA sequences not acted upon or acted upon by a restriction endonuclease or other DNA modifying enzyme, chemical, etc.; and, the inclusion of a DNA sequences required for a specific modification (e.g., methylation) that allows its identification.

Selectable marker genes for selection of transformed cells or tissues can include genes that confer antibiotic resistance or resistance to herbicides. Examples of suitable selectable marker genes include, but are not limited to, genes encoding resistance to chloramphenicol (Herrera Estrella, et al., (1983) EMBO J. 2:987-992); methotrexate (Herrera Estrella, et al., (1983) Nature 303:209-213; Meijer, et al., (1991) Plant Mol. Biol. 16:807-820); hygromycin (Waldron, et al., (1985) Plant Mol. Biol. 5:103-108 and Zhijian, et al., (1995) Plant Science 108:219-227); streptomycin (Jones, et al., (1987) Mol. Gen. Genet. 210:86-91); spectinomycin (Bretagne-Sagnard, et al., (1996) Transgenic Res. 5:131-137); bleomycin (Hille, et al., (1990) Plant Mol. Biol. 7:171-176); sulfonamide (Guerineau, et al., (1990) Plant Mol. Biol. 15:127-36); bromoxynil (Stalker, et al., (1988) Science 242:419-423); glyphosate (Shaw, et al., (1986) Science 233:478-481 and U.S. patent application Ser. Nos. 10/004,357 and 10/427,692); phosphinothricin (DeBlock, et al., (1987) EMBO J. 6:2513-2518), herein incorporated by reference in their entirety.

Selectable markers that confer resistance to herbicidal compounds include genes encoding resistance and/or tolerance to herbicidal compounds, such as glyphosate, sulfonylureas, glufosinate ammonium, bromoxynil, imidazolinones, and 2,4-dichlorophenoxyacetate (2,4-D). See generally, Yarranton (1992) Curr. Opin. Biotech. 3:506-511; Christopherson et al. (1992) Proc. Natl. Acad. Sci. USA 89:6314-6318; Yao et al. (1992) Cell 71:63-72; Reznikoff (1992) Mol. Microbiol. 6:2419-2422; Barkley et al. (1980) in The Operon, pp. 177-220; Hu et al. (1987) Cell 48:555-566; Brown et al. (1987) Cell 49:603-612; Figge et al. (1988) Cell 52:713-722; Deuschle et al. (1989) Proc. Natl. Acad. Sci. USA 86:5400-5404; Fuerst et al. (1989) Proc. Natl. Acad. Sci. USA 86:2549-2553; Deuschle et al. (1990) Science 248:480-483; Gossen (1993) Ph.D. Thesis, University of Heidelberg; Reines et al. (1993) Proc. Natl. Acad. Sci. USA 90:1917-1921; Labow et al. (1990) Mol. Cell. Biol. 10:3343-3356; Zambretti et al. (1992) Proc. Natl. Acad. Sci. USA 89:3952-3956; Baim et al. (1991) Proc. Natl. Acad. Sci. USA 88:5072-5076; Wyborski et al. (1991) Nucleic Acids Res. 19:4647-4653; Hillen and Wissman (1989) Topics Mol. Struc. Biol. 10:143-162; Degenkolb et al. (1991) Antimicrob. Agents Chemother. 35:1591-1595; Kleinschnidt et al. (1988) Biochemistry 27:1094-1104; Bonin (1993) Ph.D. Thesis, University of Heidelberg; Gossen et al. (1992) Proc. Natl. Acad. Sci. USA 89:5547-5551; Oliva et al. (1992) Antimicrob. Agents Chemother. 36:913-919; Hlavka et al. (1985) Handbook of Experimental Pharmacology, Vol. 78 (Springer-Verlag, Berlin); Gill et al. (1988) Nature 334:721-724. Such disclosures are herein incorporated by reference.

Certain selectable markers useful in the present methods include, but are not limited to, the maize HRA gene (Lee et al., 1988, EMBO J 7:1241-1248) which confers resistance to sulfonylureas and imidazolinones, the GAT gene which confers resistance to glyphosate (Castle et al., 2004, Science 304:1151-1154), genes that confer resistance to spectinomycin such as the aadA gene (Svab et al., 1990, Plant Mol Biol. 14:197-205) and the bar gene that confers resistance to glufosinate ammonium (White et al., 1990, Nucl. Acids Res. 25:1062), and PAT (or moPAT for corn, see Rasco-Gaunt et al., 2003, Plant Cell Rep. 21:569-76) and the PMI gene that permits growth on mannose-containing medium (Negrotto et al., 2000, Plant Cell Rep. 22:684-690) are very useful for rapid selection during the brief elapsed time encompassed by somatic embryogenesis and embry maturation of the method. However, depending on the selectable marker used and the crop, inbred or variety being transformed, the percentage of wild-type escapes can vary. In maize and *sorghum*, the HRA gene is efficacious in reducing the frequency of wild-type escapes.

Other genes that could have utility in the recovery of transgenic events would include, but are not limited to, examples such as GUS (beta-glucuronidase; Jefferson, (1987) Plant Mol. Biol. Rep. 5:387), GFP (green fluorescence protein; Chalfie, et al., (1994) Science 263:802), luciferase (Riggs, et al., (1987) Nucleic Acids Res. 15(19): 8115 and Luehrsen, et al., (1992) Methods Enzymol. 216: 397-414), various fluorescent proteins with a spectrum of alternative emission optima spanning Far-Red, Red, Orange, Yellow, Green Cyan and Blue (Shaner et al., 2005, Nature Methods 2:905-909) and the maize genes encoding for anthocyanin production (Ludwig, et al., (1990) Science 247:449), herein incorporated by reference in their entireties.

The above list of selectable markers is not meant to be limiting. Any selectable marker can be used in the methods of the disclosure.

In an aspect, the methods of the disclosure provide transformation methods that allow positive growth selection. One skilled in the art can appreciate that conventional plant transformation methods have relied predominantly on negative selection schemes as described above, in which an antibiotic or herbicide (a negative selective agent) is used to inhibit or kill non-transformed cells or tissues, and the transgenic cells or tissues continue to grow due to expression of a resistance gene. In contrast, the methods of the present disclosure can be used with no application of a negative selective agent. Thus, although wild-type cells can grow unhindered, by comparison cells impacted by the controlled expression of a morphogenic gene can be readily identified due to their accelerated growth rate relative to the surrounding wild-type tissue. In addition to simply observing faster growth, the methods of the disclosure provide transgenic cells that exhibit more rapid morphogenesis relative to non-transformed cells. Accordingly, such differential growth and morphogenic development can be used to easily distinguish transgenic plant structures from the surrounding non-transformed tissue, a process which is termed herein as "positive growth selection."

The present disclosure provides methods for producing transgenic plants with increased efficiency and speed and providing significantly higher transformation frequencies and significantly more quality events (events containing one copy of a trait gene expression cassette with no vector (plasmid) backbone) in multiple inbred lines using a variety of starting tissue types, including transformed inbreds representing a range of genetic diversities and having significant commercial utility. The disclosed methods can further comprise polynucleotides that provide for improved traits and characteristics.

As used herein, "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g. by measuring uptake of carbon dioxide, or by the observation of the expression level of a gene or genes, e.g., by employing Northern analysis, RT-PCR, microarray gene expression assays, or reporter gene expression systems, or by agricultural observations such as stress tolerance, yield, or pathogen tolerance.

Agronomically important traits such as oil, starch, and protein content can be genetically altered in addition to using traditional breeding methods. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885,802, and 5,990,389, herein incorporated by reference. Another example is lysine and/or sulfur rich seed protein encoded by the soybean 2S albumin described in U.S. Pat. No. 5,850,016, and the chymotrypsin inhibitor from barley, described in Williamson et al. (1987) Eur. J. Biochem. 165:99-106, the disclosures of which are herein incorporated by reference.

Derivatives of the coding sequences can be made by site-directed mutagenesis to increase the level of preselected amino acids in the encoded polypeptide. For example, methionine-rich plant proteins such as from sunflower seed (Lilley et al. (1989) Proceedings of the World Congress on Vegetable Protein Utilization in Human Foods and Animal Feedstuffs, ed. Applewhite (American Oil Chemists Society, Champaign, Ill.), pp. 497-502; herein incorporated by reference); corn (Pedersen et al. (1986) J. Biol. Chem. 261: 6279; Kirihara et al. (1988) Gene 71:359; both of which are herein incorporated by reference); and rice (Musumura et al. (1989) Plant Mol. Biol. 12:123, herein incorporated by reference) could be used. Other agronomically important genes encode latex, Floury 2, growth factors, seed storage factors, and transcription factors.

Many agronomic traits can affect "yield", including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Other traits that can affect yield include, efficiency of germination (including germination in stressed conditions), growth rate (including growth rate in stressed conditions), ear number, seed number per ear, seed size, composition of seed (starch, oil, protein) and characteristics of seed fill. Also of interest is the generation of transgenic plants that demonstrate desirable phenotypic properties that may or may not confer an increase in overall plant yield. Such properties include enhanced plant morphology, plant physiology or improved components of the mature seed harvested from the transgenic plant.

"Increased yield" of a transgenic plant of the present disclosure may be evidenced and measured in a number of ways, including test weight, seed number per plant, seed weight, seed number per unit area (i.e. seeds, or weight of seeds, per acre), bushels per acre, tons per acre, kilo per hectare. For example, maize yield may be measured as production of shelled corn kernels per unit of production area, e.g. in bushels per acre or metric tons per hectare, often reported on a moisture adjusted basis, e.g., at 15.5% moisture. Increased yield may result from improved utilization of key biochemical compounds, such as nitrogen, phosphorous and carbohydrate, or from improved tolerance to environmental stresses, such as cold, heat, drought, salt, and attack by pests or pathogens. Trait-enhancing recombinant DNA may also be used to provide transgenic plants having improved growth and development, and ultimately increased yield, as the result of modified expression of plant growth regulators or modification of cell cycle or photosynthesis pathways.

An "enhanced trait" as used in describing the aspects of the present disclosure includes improved or enhanced water use efficiency or drought tolerance, osmotic stress tolerance, high salinity stress tolerance, heat stress tolerance, enhanced cold tolerance, including cold germination tolerance, increased yield, improved seed quality, enhanced nitrogen use efficiency, early plant growth and development, late plant growth and development, enhanced seed protein, and enhanced seed oil production.

Any polynucleotide of interest or trait gene can be used in the methods of the disclosure. Various changes in phenotype, imparted by a gene of interest or trait gene, include those for modifying the fatty acid composition in a plant, altering the amino acid content, starch content, or carbohydrate content of a plant, altering a plant's pathogen defense mechanism, altering kernel size, altering sucrose loading, and the like. The gene of interest or trait gene may also be involved in regulating the influx of nutrients, and in regulating expression of phytate genes particularly to lower phytate levels in the seed. These results can be achieved by providing expression of heterologous products or increased expression of endogenous products in plants. Alternatively, the results can be achieved by providing for a reduction of expression of one or more endogenous products, particularly enzymes or cofactors in the plant. These changes result in a change in phenotype of the transformed plant.

As used herein, "trait gene" means a gene of interest to be integrated into the plant genome to produce a fertile transgenic T0 plant. Selectable markers such as the Highly-Resistant Acetolactate Synthase (HRA) and visual makers such as fluorescent protein genes are used herein by way of example. A trait gene could be any gene (or combination of genes) that confer a value-added agronomic, physiological, biochemical, or physical phenotype.

Genes of interest/trait genes are reflective of the commercial markets and interests of those involved in the development of the crop. Crops and markets of interest change, and as developing nations open up world markets, new crops and technologies will emerge also. In addition, as the understanding of agronomic traits and characteristics such as yield and heterosis increase, the choice of genes and traits for transformation will change accordingly. General categories of nucleotide sequences or genes of interest or trait genes useful in the methods of the disclosure include, for example, those genes involved in information, such as zinc fingers, those involved in communication, such as kinases, and those involved in housekeeping, such as heat shock proteins. More specific categories of transgenes, for example, include genes encoding important traits for agronomics, insect resistance, disease resistance, herbicide resistance, sterility, environmental stress resistance (altered tolerance to cold, salt, drought, etc.), grain characteristics, and commercial products.

Heterologous coding sequences, heterologous polynucleotides, and polynucleotides of interest expressed by a promoter sequence transformed by the methods disclosed herein may be used for varying the phenotype of a plant. Various changes in phenotype are of interest including modifying expression of a gene in a plant, altering a plant's pathogen or insect defense mechanism, increasing a plant's tolerance to herbicides, altering plant development to respond to environmental stress, modulating the plant's response to salt, temperature (hot and cold), drought and the like. These results can be achieved by the expression of a heterologous nucleotide sequence of interest comprising an appropriate gene product. In specific aspects, the heterologous nucleotide sequence of interest is an endogenous plant sequence whose expression level is increased in the plant or plant part. Results can be achieved by providing for altered expression of one or more endogenous gene products, particularly hormones, receptors, signaling molecules, enzymes, transporters or cofactors or by affecting nutrient uptake in the plant. These changes result in a change in phenotype of the transformed plant. Still other categories of transgenes include genes for inducing expression of exogenous products such as enzymes, cofactors, and hormones from plants and other eukaryotes as well as prokaryotic organisms.

It is recognized that any gene of interest, polynucleotide of interest, trait gene or multiple genes/polynucleotides/traits of interest can be operably linked to a promoter or promoters and expressed in a plant transformed by the methods disclosed herein, for example insect resistance trait genes which can be stacked with one or more additional input trait genes (e.g., herbicide resistance, fungal resistance, virus resistance, stress tolerance, disease resistance, male sterility, stalk strength, and the like) or output trait genes (e.g., increased yield, modified starches, improved oil profile, balanced amino acids, high lysine or methionine, increased digestibility, improved fiber quality, drought resistance, and the like).

A promoter can be operably linked to agronomically important trait genes for expression in plants transformed by the methods disclosed herein that affect quality of grain, such as levels (increasing content of oleic acid) and types of oils, saturated and unsaturated, quality and quantity of essential amino acids, increasing levels of lysine and sulfur, levels of cellulose, and starch and protein content. A promoter can be operably linked to trait genes providing hordothionin protein modifications for expression in plants transformed by the methods disclosed herein which are described in U.S. Pat. Nos. 5,990,389; 5,885,801; 5,885,802 and 5,703,049; herein incorporated by reference in their entirety. Another example of a trait gene to which a promoter can be operably linked to for expression in plants transformed by the methods disclosed herein is a lysine and/or sulfur rich seed protein encoded by the soybean 2S albumin described in U.S. Pat. No. 5,850,016, and the chymotrypsin inhibitor from barley, Williamson, et al., (1987) Eur. J. Biochem 165:99-106, the disclosures of which are herein incorporated by reference in their entirety.

A promoter can be operably linked to insect resistance trait genes that encode resistance to pests that have yield drag such as rootworm, cutworm, European corn borer and the like for expression in plants transformed by the methods disclosed herein. Such genes include, for example, *Bacillus thuringiensis* toxic protein genes, U.S. Pat. Nos. 5,366,892; 5,747,450; 5,736,514; 5,723,756; 5,593,881 and Geiser, et al., (1986) Gene 48:109, the disclosures of which are herein incorporated by reference in their entirety. Trait genes encoding disease resistance traits that can be operably linked to a promoter for expression in plants transformed by the methods disclosed herein include, for example, detoxification genes, such as those which detoxify fumonisin (U.S. Pat. No. 5,792,931); avirulence (avr) and disease resistance (R) genes (Jones, et al., (1994) Science 266:789; Martin, et al., (1993) Science 262:1432; and Mindrinos, et al., (1994) Cell 78:1089), herein incorporated by reference in their entirety.

Herbicide resistance trait genes that can be operably linked to a promoter for expression in plants transformed by the methods disclosed herein include genes coding for resistance to herbicides that act to inhibit the action of acetolactate synthase (ALS), in particular the sulfonylurea-type herbicides (e.g., the acetolactate synthase (ALS) gene containing mutations leading to such resistance, in particular the S4 and/or Hra mutations), genes coding for resistance to herbicides that act to inhibit action of glutamine synthase, such as phosphinothricin or basta (e.g., the bar gene), genes coding for resistance to glyphosate (e.g., the EPSPS gene and the GAT gene; see, for example, US Patent Application Publication Number 2004/0082770, WO 03/092360 and WO 05/012515, herein incorporated by reference in their entirety) or other such genes known in the art. The bar gene encodes resistance to the herbicide basta, the nptII gene encodes resistance to the antibiotics kanamycin and geneticin and the ALS-gene mutants encode resistance to the herbicide chlorsulfuron any and all of which can be operably linked to a promoter for expression in plants transformed by the methods disclosed herein.

Glyphosate resistance is imparted by mutant 5-enolpyruvl-3-phosphikimate synthase (EPSPS) and aroA genes which can be operably linked to a promoter for expression in plants transformed by the methods disclosed herein. See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes which can be operably linked to a promoter for expression in plants transformed by the methods disclosed herein. See also, U.S. Pat. Nos. 6,248,876 B1; 6,040,497; 5,804,425; 5,633,435; 5,145,783; 4,971,908; 5,312,910; 5,188,642; 4,940,835; 5,866,775; 6,225,114 B1; 6,130,366; 5,310,667; 4,535,060; 4,769,061; 5,633,448; 5,510,471; Re. 36,449; RE 37,287 E and 5,491,288 and international publications WO 97/04103; WO 97/04114; WO 00/66746; WO 01/66704; WO 00/66747 and WO 00/66748, which are incorporated herein by reference in their entirety. Glyphosate resistance is also imparted to plants that express a gene which can be operably linked to a promoter for expression in plants transformed by the methods disclosed herein that encodes a glyphosate oxido-reductase enzyme as described more fully in U.S. Pat. Nos. 5,776,760 and 5,463,175, which are incorporated herein by reference in their entirety. Glyphosate resistance can also be imparted to plants by the over expression of genes which can be operably linked to a promoter for expression in plants transformed by the methods disclosed herein encoding glyphosate N-acetyltransferase. See, for example, US Patent Application Publication Number 2004/0082770, WO 03/092360 and WO 05/012515, herein incorporated by reference in their entirety.

Sterility genes operably linked to a promoter for expression in plants transformed by the methods disclosed herein can also be encoded in a DNA construct and provide an alternative to physical detasseling. Examples of genes used in such ways include male tissue-preferred genes and genes with male sterility phenotypes such as QM, described in U.S. Pat. No. 5,583,210, herein incorporated by reference in its entirety. Other genes which can be operably linked to a promoter for expression in plants transformed by the methods disclosed herein include kinases and those encoding compounds toxic to either male or female gametophytic development.

Commercial traits can also be encoded by a gene or genes operably linked to a promoter for expression in plants transformed by the methods disclosed herein that could increase for example, starch for ethanol production, or provide expression of proteins. Another important commercial use of transformed plants is the production of polymers and bioplastics such as described in U.S. Pat. No. 5,602,321, herein incorporated by reference in its entirety. Genes such as β-Ketothiolase, PHBase (polyhydroxybutyrate synthase), and acetoacetyl-CoA reductase, which facilitate expression of polyhydroxyalkanoates (PHAs) can be operably linked to a promoter for expression in plants transformed by the methods disclosed herein (see, Schubert, et al., (1988) J. Bacteriol. 170:5837-5847, herein incorporated by reference in its entirety).

Examples of other applicable trait genes and their associated phenotype which can be operably linked to a promoter for expression in plants transformed by the methods disclosed herein include genes that encode viral coat proteins and/or RNAs, or other viral or plant genes that confer viral resistance; genes that confer fungal resistance; genes that promote yield improvement; and genes that provide for resistance to stress, such as cold, dehydration resulting from drought, heat and salinity, toxic metal or trace elements or the like.

By way of illustration, without intending to be limiting, the following is a list of other examples of the types of trait genes which can be operably linked to a promoter for expression in plants transformed by the methods disclosed herein.

1. Trait Genes that Confer Resistance to Insects or Disease and that Encode:

(A) Plant disease resistance genes. Plant defenses are often activated by specific interaction between the product of a disease resistance gene (R) in the plant and the product of a corresponding avirulence (Avr) gene in the pathogen. A plant variety can be transformed with a cloned resistance gene to engineer plants that are resistant to specific pathogen strains. See, for example Jones, et al., (1994) Science 266: 789 (cloning of the tomato Cf-9 gene for resistance to *Cladosporium fulvum*); Martin, et al., (1993) Science 262:1432 (tomato Pto gene for resistance to *Pseudomonas syringae* pv. tomato encodes a protein kinase); Mindrinos, et al., (1994) Cell 78:1089 (*Arabidopsis* RSP2 gene for resistance to *Pseudomonas syringae*); McDowell and Woffenden, (2003) Trends Biotechnol. 21(4):178-83 and Toyoda, et al., (2002) Transgenic Res. 11(6):567-82, herein incorporated by reference in their entirety. A plant resistant to a disease is one that is more resistant to a pathogen as compared to the wild type plant.

(B) A *Bacillus thuringiensis* protein, a derivative thereof or a synthetic polypeptide modeled thereon. See, for example, Geiser, et al., (1986) Gene 48:109, who disclose the cloning and nucleotide sequence of a Bt delta-endotoxin gene. Moreover, DNA molecules encoding delta-endotoxin genes can be purchased from American Type Culture Collection (Rockville, MD.), for example, under ATCC Accession Numbers 40098, 67136, 31995 and 31998. Other examples of *Bacillus thuringiensis* transgenes being genetically engineered are given in the following patents and patent applications and hereby are incorporated by reference for this purpose: U.S. Pat. Nos. 5,188,960; 5,689,052; 5,880,275; WO 91/14778; WO 99/31248; WO 01/12731; WO 99/24581; WO 97/40162 and U.S. application Ser. Nos. 10/032,717; 10/414,637 and 10/606,320, herein incorporated by reference in their entirety.

(C) An insect-specific hormone or pheromone such as an ecdysteroid and juvenile hormone, a variant thereof, a mimetic based thereon, or an antagonist or agonist thereof. See, for example, the disclosure by Hammock, et al., (1990) Nature 344:458, of baculovirus expression of cloned juvenile hormone esterase, an inactivator of juvenile hormone, herein incorporated by reference in its entirety.

(D) An insect-specific peptide which, upon expression, disrupts the physiology of the affected pest. For example, see the disclosures of Regan, (1994) J. Biol. Chem. 269:9 (expression cloning yields DNA coding for insect diuretic hormone receptor); Pratt, et al., (1989) Biochem. Biophys. Res. Comm. 163: 1243 (an allostatin is identified in *Diploptera puntata*); Chattopadhyay, et al., (2004) Critical Reviews in Microbiology 30(1):33-54; Zjawiony, (2004) J Nat Prod 67(2):300-310; Carlini and Grossi-de-Sa, (2002) Toxicon 40(11):1515-1539; Ussuf, et al., (2001) Curr Sci. 80(7):847-853 and Vasconcelos and Oliveira, (2004) Toxicon 44(4):385-403, herein incorporated by reference in their entirety. See also, U.S. Pat. No. 5,266,317 to Tomalski, et al., who disclose genes encoding insect-specific toxins, herein incorporated by reference in its entirety.

(E) An enzyme responsible for a hyperaccumulation of a monterpene, a sesquiterpene, a steroid, hydroxamic acid, a phenylpropanoid derivative or another non-protein molecule with insecticidal activity.

(F) An enzyme involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See, PCT Application Number WO 93/02197 in the name of Scott, et al., which discloses the nucleotide sequence of a callase gene, herein incorporated by reference in its entirety. DNA molecules which contain chitinase-encoding sequences can be obtained, for example, from the ATCC under Accession Numbers 39637 and 67152. See also, Kramer, et al., (1993) Insect Biochem. Molec. Biol. 23:691, who teach the nucleotide sequence of a cDNA encoding tobacco hookworm chitinase, and Kawalleck, et al., (1993) Plant Molec. Biol. 21:673, who provide the nucleotide sequence of the parsley ubi4-2 polyubiquitin gene, U.S. patent application Ser. Nos. 10/389,432, 10/692,367 and U.S. Pat. No. 6,563,020, herein incorporated by reference in their entirety.

(G) A molecule that stimulates signal transduction. For example, see the disclosure by Botella, et al., (1994) Plant Molec. Biol. 24:757, of nucleotide sequences for mung bean calmodulin cDNA clones, and Griess, et al., (1994) Plant Physiol. 104:1467, who provide the nucleotide sequence of a maize calmodulin cDNA clone, herein incorporated by reference in their entirety.

(H) A hydrophobic moment peptide. See, PCT Application Number WO 95/16776 and U.S. Pat. No. 5,580,852 (disclosure of peptide derivatives of Tachyplesin which inhibit fungal plant pathogens) and PCT Application Number WO 95/18855 and U.S. Pat. No. 5,607,914) (teaches synthetic antimicrobial peptides that confer disease resistance), herein incorporated by reference in their entirety.

(I) A membrane permease, a channel former or a channel blocker. For example, see the disclosure by Jaynes, et al., (1993) Plant Sci. 89:43, of heterologous expression of a cecropin-beta lytic peptide analog to render transgenic tobacco plants resistant to *Pseudomonas solanacearum*, herein incorporated by reference in its entirety.

(J) A viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. See, Beachy, et al., (1990) Ann. Rev. Phytopathol. 28:451, herein incorporated by reference in its entirety. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. Id.

(K) An insect-specific antibody or an immunotoxin derived therefrom. Thus, an antibody targeted to a critical metabolic function in the insect gut would inactivate an affected enzyme, killing the insect. Cf. Taylor, et al., Abstract #497, SEVENTH INT'L SYMPOSIUM ON MOLECULAR PLANT-MICROBE INTERACTIONS (Edinburgh, Scotland, 1994) (enzymatic inactivation in transgenic tobacco via production of single-chain antibody fragments), herein incorporated by reference in its entirety.

(L) A virus-specific antibody. See, for example, Tavladoraki, et al., (1993) Nature 366:469, who show that transgenic plants expressing recombinant antibody genes are protected from virus attack, herein incorporated by reference in its entirety.

(M) A developmental-arrestive protein produced in nature by a pathogen or a parasite. Thus, fungal endo alpha-1,4-D-polygalacturonases facilitate fungal colonization and plant nutrient release by solubilizing plant cell wall homo-alpha-1,4-D-galacturonase. See, Lamb, et al., (1992) Bio/Technology 10:1436, herein incorporated by reference in its entirety. The cloning and characterization of a gene which encodes a bean endopolygalacturonase-inhibiting protein is described by Toubart, et al., (1992) Plant J. 2:367, herein incorporated by reference in its entirety.

(N) A developmental-arrestive protein produced in nature by a plant. For example, Logemann, et al., (1992) Bio/Technology 10:305, herein incorporated by reference in its entirety, have shown that transgenic plants expressing the barley ribosome-inactivating gene have an increased resistance to fungal disease.

(O) Genes involved in the Systemic Acquired Resistance (SAR) Response and/or the pathogenesis related genes. Briggs, (1995) Current Biology 5(2): 128-131, Pieterse and Van Loon, (2004) Curr. Opin. Plant Bio. 7(4):456-64 and Somssich, (2003) Cell 113(7):815-6, herein incorporated by reference in their entirety.

(P) Antifungal genes (Cornelissen and Melchers, (1993) Pl. Physiol. 101:709-712 and Parijs, et al., (1991) Planta 183:258-264 and Bushnell, et al., (1998) Can. J. of Plant Path. 20(2):137-149. Also see, U.S. patent application Ser. No. 09/950,933, herein incorporated by reference in their entirety.

(Q) Detoxification genes, such as for fumonisin, beauvericin, moniliformin and zearalenone and their structurally related derivatives. For example, see, U.S. Pat. No. 5,792,931, herein incorporated by reference in its entirety.

(R) Cystatin and cysteine proteinase inhibitors. See, U.S. application Ser. No. 10/947,979, herein incorporated by reference in its entirety.

(S) Defensin genes. See, WO03/000863 and U.S. application Ser. No. 10/178,213, herein incorporated by reference in their entirety.

(T) Genes conferring resistance to nematodes. See, WO 03/033651 and Urwin, et. al., (1998) Planta 204:472-479, Williamson (1999) Curr Opin Plant Bio. 2(4): 327-31, herein incorporated by reference in their entirety.

(U) Genes such as rcg1conferring resistance to Anthracnose stalk rot, which is caused by the fungus *Colletotrichum graminiola*. See, Jung, et al., Generation-means analysis and quantitative trait locus mapping of Anthracnose Stalk Rot genes in Maize, Theor. Appl. Genet. (1994) 89:413-418, as well as, U.S. Provisional Patent Application No. 60/675,664, herein incorporated by reference in their entirety.

2. Trait Genes that Confer Resistance to a Herbicide, for Example:

(A) A herbicide that inhibits the growing point or meristem, such as an imidazolinone or a sulfonylurea. Exemplary genes in this category code for mutant ALS and AHAS enzyme as described, for example, by Lee, et al., (1988) EMBO J. 7:1241 and Miki, et al., (1990) Theor. Appl. Genet. 80:449, respectively. See also, U.S. Pat. Nos. 5,605,011; 5,013,659; 5,141,870; 5,767,361; 5,731,180; 5,304,732; 4,761,373; 5,331,107; 5,928,937 and 5,378,824 and international publication WO 96/33270, which are incorporated herein by reference in their entirety.

(B) Glyphosate (resistance imparted by mutant 5-enolpyruvl-3-phosphikimate synthase (EPSP) and aroA genes, respectively) and other phosphono compounds such as glufosinate (phosphinothricin acetyl transferase (PAT) and *Streptomyces hygroscopicus* phosphinothricin acetyl transferase (bar) genes) and pyridinoxy or phenoxy proprionic acids and cycloshexones (ACCase inhibitor-encoding genes). See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes. See also, U.S. Pat. Nos. 6,566,587; 6,338,961; 6,248,876 B1; 6,040,497; 5,804,425; 5,633,435; 5,145,783; 4,971,908; 5,312,910; 5,188,642; 4,940,835; 5,866,775; 6,225,114 B1; 6,130,366; 5,310,667; 4,535,060; 4,769,061; 5,633,448; 5,510,471; Re. 36,449; RE 37,287 E and 5,491,288 and international publications EP1173580; WO 01/66704; EP1173581 and EP1173582, which are incorporated herein by reference in their entirety. Glyphosate resistance is also imparted to plants that express a gene that encodes a glyphosate oxido-reductase enzyme as described more fully in U.S. Pat. Nos. 5,776,760 and 5,463,175, which are incorporated herein by reference in their entirety. In addition, glyphosate resistance can be imparted to plants by the over expression of genes encoding glyphosate N-acetyltransferase. See, for example, US Patent Application Publication Number 2004/0082770, WO 03/092360 and WO 05/012515, herein incorporated by reference in their entirety. A DNA molecule encoding a mutant aroA gene can be obtained under ATCC Accession Number 39256 and the nucleotide sequence of the mutant gene is disclosed in U.S. Pat. No. 4,769,061 to Comai, herein incorporated by reference in its entirety. EP Patent Application Number 0 333 033 to Kumada, et al., and U.S. Pat. No. 4,975,374 to Goodman, et al., disclose nucleotide sequences of glutamine synthetase genes which confer resistance to herbicides such as L-phosphinothricin, herein incorporated by reference in their entirety. The nucleotide sequence of a phosphinothricin-acetyl-transferase gene is provided in EP Patent Numbers 0 242 246 and 0 242 236 to Leemans, et al., De Greef, et al., (1989) Bio/Technology 7:61 which describe the production of transgenic plants that express chimeric bar genes coding for phosphinothricin acetyl transferase activity, herein incorporated by reference in their entirety. See also, U.S. Pat. Nos. 5,969,213; 5,489,520; 5,550,318; 5,874,265; 5,919,675; 5,561,236; 5,648,477; 5,646,024; 6,177,616 B1 and 5,879,903, herein incorporated by reference in their entirety. Exemplary genes conferring resistance to phenoxy proprionic acids and cycloshexones, such as sethoxydim and haloxyfop, are the Acc1-S1, Acc1-S2 and Acc1-S3 genes described by Marshall, et al., (1992) Theor. Appl. Genet. 83:435, herein incorporated by reference in its entirety.

(C) A herbicide that inhibits photosynthesis, such as a triazine (psbA and gs+ genes) and a benzonitrile (nitrilase gene). Przibilla, et al., (1991) Plant Cell 3:169, herein incorporated by reference in its entirety, describe the transformation of *Chlamydomonas* with plasmids encoding mutant psbA genes. Nucleotide sequences for nitrilase genes are disclosed in U.S. Pat. No. 4,810,648 to Stalker, herein incorporated by reference in its entirety, and DNA molecules containing these genes are available under ATCC Accession Numbers 53435, 67441 and 67442. Cloning and expression of DNA coding for a glutathione S-transferase is described by Hayes, et al., (1992) Biochem. J. 285:173, herein incorporated by reference in its entirety.

(D) Acetohydroxy acid synthase, which has been found to make plants that express this enzyme resistant to multiple types of herbicides, has been introduced into a variety of plants (see, e.g., Hattori, et al., (1995) Mol Gen Genet 246:419, herein incorporated by reference in its entirety). Other genes that confer resistance to herbicides include: a gene encoding a chimeric protein of rat cytochrome P4507A1 and yeast NADPH-cytochrome P450 oxidoreductase (Shiota, et al., (1994) Plant Physiol. 106(1):17-23), genes for glutathione reductase and superoxide dismutase (Aono, et al., (1995) Plant Cell Physiol 36:1687, and genes for various phosphotransferases (Datta, et al., (1992) Plant Mol Biol 20:619), herein incorporated by reference in their entirety.

(E) Protoporphyrinogen oxidase (protox) is necessary for the production of chlorophyll, which is necessary for all plant survival. The protox enzyme serves as the target for a variety of herbicidal compounds. These herbicides also inhibit growth of all the different species of plants present, causing their total destruction. The development of plants containing altered protox activity which are resistant to these herbicides are described in U.S. Pat. Nos. 6,288,306 B1; 6,282,837 B1 and 5,767,373; and international publication number WO 01/12825, herein incorporated by reference in their entirety.

3. Trait Genes that Confer or Contribute to an Altered Grain Characteristic, Such as:

(A) Altered fatty acids, for example, by (1) Down-regulation of stearoyl-ACP desaturase to increase stearic acid content of the plant. See, Knultzon, et al., (1992) Proc. Natl. Acad. Sci. USA 89:2624 and WO99/64579 (Genes for Desaturases to Alter Lipid Profiles in Corn), herein incorporated by reference in their entirety, (2) Elevating oleic acid via FAD-2 gene modification and/or decreasing linolenic acid via FAD-3 gene modification (see, U.S. Pat. Nos. 6,063,947; 6,323,392; 6,372,965 and WO 93/11245, herein incorporated by reference in their entirety), (3) Altering conjugated linolenic or linoleic acid content, such as in WO 01/12800, herein incorporated by reference in its entirety, (4) Altering LEC1, AGP, Dekl, Superall, milps, various 1pa genes such as 1pa1, 1pa3, hpt or hggt. For example, see, WO 02/42424, WO 98/22604, WO 03/011015, U.S. Pat. Nos. 6,423,886, 6,197, 561, 6,825,397, US Patent Application Publication Numbers 2003/0079247, 2003/0204870, WO02/057439, WO03/011015 and Rivera-Madrid, et. al., (1995) Proc. Natl. Acad. Sci. 92:5620-5624, herein incorporated by reference in their entirety.

(B) Altered phosphorus content, for example, by the (1) Introduction of a phytase-encoding gene would enhance breakdown of phytate, adding more free phosphate to the transformed plant. For example, see, Van Hartingsveldt, et al., (1993) Gene 127:87, for a disclosure of the nucleotide sequence of an *Aspergillus niger* phytase gene, herein incorporated by reference in its entirety.

(2) Up-regulation of a gene that reduces phytate content. In maize, this, for example, could be accomplished, by cloning and then re-introducing DNA associated with one or more of the alleles, such as the LPA alleles, identified in maize mutants characterized by low levels of phytic acid, such as in Raboy, et al., (1990) Maydica 35:383 and/or by altering inositol kinase activity as in WO 02/059324, US Patent Application Publication Number 2003/0009011, WO 03/027243, US Patent Application Publication Number 2003/0079247, WO 99/05298, U.S. Pat. Nos. 6,197, 561, 6,291,224, 6,391,348, WO2002/059324, US Patent Application Publication Number 2003/0079247, WO98/45448, WO99/55882, WO01/04147, herein incorporated by reference in their entirety.

(C) Altered carbohydrates effected, for example, by altering a gene for an enzyme that affects the branching pattern of starch or a gene altering thioredoxin such as NTR and/or TRX (see, U.S. Pat. No. 6,531, 648, which is incorporated by reference in its entirety) and/or a gamma zein knock out or mutant such as cs27 or TUSC27 or en27 (see, U.S. Pat. No. 6,858,778 and US Patent Application Publication Numbers 2005/0160488 and 2005/0204418; which are incorporated by reference in its entirety). See, Shiroza, et al., (1988) J. Bacteriol. 170:810 (nucleotide sequence of *Streptococcus mutans* fructosyltransferase gene), Steinmetz, et al., (1985) Mol. Gen. Genet. 200:220 (nucleotide sequence of *Bacillus subtilis* levansucrase gene), Pen, et al., (1992) Bio/Technology 10:292 (production of transgenic plants that express *Bacillus licheniformis* alpha-amylase), Elliot, et al., (1993) Plant Molec. Biol. 21:515 (nucleotide sequences of tomato invertase genes), Søgaard, et al., (1993) J. Biol. Chem. 268:22480 (site-directed mutagenesis of barley alpha-amylase gene) and Fisher, et al., (1993) Plant Physiol. 102:1045 (maize endosperm starch branching enzyme II), WO 99/10498 (improved digestibility and/or starch extraction through modification of UDP-D-xylose 4-epimerase, Fragile 1 and 2, Ref1, HCHL, C4H), U.S. Pat. No. 6,232,529 (method of producing high oil seed by modification of starch levels (AGP)), herein incorporated by reference in their entirety. The fatty acid modification genes mentioned above may also be used to affect starch content and/or composition through the interrelationship of the starch and oil pathways.

(D) Altered antioxidant content or composition, such as alteration of tocopherol or tocotrienols. For example, see U.S. Pat. No. 6,787,683, US Patent Application Publication Number 2004/0034886 and WO 00/68393 involving the manipulation of antioxidant levels through alteration of a phytl prenyl transferase (ppt), WO 03/082899 through alteration of a homogentisate geranyl geranyl transferase (hggt), herein incorporated by reference in their entirety.

(E) Altered essential seed amino acids. For example, see U.S. Pat. No. 6,127,600 (method of increasing accumulation of essential amino acids in seeds), U.S. Pat. No. 6,080,913 (binary methods of increasing accumulation of essential amino acids in seeds), U.S. Pat. No. 5,990,389 (high lysine), WO99/40209 (alteration of amino acid compositions in seeds), WO99/29882 (methods for altering amino acid content of proteins), U.S. Pat. No. 5,850,016 (alteration of amino acid compositions in seeds), WO98/20133 (proteins with enhanced levels of essential amino acids), U.S. Pat. No. 5,885,802 (high methionine), U.S. Pat. No. 5,885,801 (high threonine), U.S. Pat. No. 6,664,445 (plant amino acid biosynthetic enzymes), U.S. Pat. No. 6,459,019 (increased lysine and threonine), U.S. Pat. No. 6,441,274 (plant tryptophan synthase beta subunit), U.S. Pat. No. 6,346,403 (methionine metabolic enzymes), U.S. Pat. No. 5,939,599 (high sulfur), U.S. Pat. No. 5,912,414 (increased methionine), WO98/56935 (plant amino acid biosynthetic enzymes), WO98/45458 (engineered seed protein having higher percentage of essential amino acids), WO98/42831 (increased lysine), U.S. Pat. No. 5,633,436 (increasing sulfur amino acid content), U.S. Pat. No. 5,559,223 (synthetic storage proteins with defined structure containing programmable levels of essential amino acids for improvement of the nutritional value of plants), WO96/01905 (increased threonine), WO95/15392 (increased lysine), US Patent Application Publication Number 2003/0163838, US Patent Application Publication Number 2003/0150014, US Patent Application Publication Number 2004/0068767, U.S. Pat. No. 6,803,498, WO01/79516, and WO00/09706 (Ces A: cellulose synthase), U.S. Pat. No. 6,194,638 (hemicellulose), U.S. Pat. No. 6,399,859 and US Patent Application Publication Number 2004/0025203 (UDPGdH), U.S. Pat. No. 6,194,638 (RGP), herein incorporated by reference in their entirety.

Additional genes may be included in the expression cassettes useful in the methods disclosed herein. Non-limiting examples include:

A. Genes that create a site for site specific DNA integration

This includes the introduction of FRT sites that may be used in the FLP/FRT system and/or Lox sites that may be used in the Cre/Loxp system. For example, see Lyznik, et al., (2003) Plant Cell Rep 21:925-932 and WO 99/25821, which are hereby incorporated by reference in their entirety. Other systems that may be used include the Gin recombinase of phage Mu (Maeser, et al., 1991; Vicki Chandler, The Maize Handbook ch. 118 (Springer-Verlag 1994), the Pin recombinase of *E. coli* (Enomoto, et al., 1983), and the R/RS system of the pSR1 plasmid (Araki, et al., 1992), herein incorporated by reference in their entirety.

B. Genes that affect abiotic stress resistance (including but not limited to flowering, ear and seed development, enhancement of nitrogen utilization efficiency, altered nitrogen responsiveness, drought resistance or tolerance, cold resistance or tolerance, and salt resistance or tolerance) and increased yield under stress. For example, see, WO 00/73475 where water use efficiency is altered through alteration of malate; U.S. Pat. Nos. 5,892,009, 5,965,705, 5,929,305, 5,891,859, 6,417,428, 6,664,446, 6,706,866, 6,717,034, WO2000060089, WO2001026459, WO2001035725, WO2001034726, WO2001035727, WO2001036444, WO2001036597, WO2001036598, WO2002015675, WO2002017430, WO2002077185, WO2002079403, WO2003013227, WO2003013228, WO2003014327, WO2004031349, WO2004076638, WO9809521, and WO9938977 describing genes, including CBF genes and transcription factors effective in mitigating the negative effects of freezing, high salinity, and drought on plants, as well as conferring other positive effects on plant phenotype; US Patent Application Publication Number 2004/0148654 and WO01/36596 where abscisic acid is altered in plants resulting in improved plant phenotype such as increased yield and/or increased tolerance to abiotic stress; WO2000/006341, WO04/090143, U.S. patent application Ser. No. 10/817,483 and U.S. Pat. No. 6,992,237, where cytokinin expression is modified resulting in plants with increased stress tolerance, such as drought tolerance, and/or increased yield, herein incorporated by reference in their entirety. Also see WO0202776, WO2003052063, JP2002281975, U.S. Pat. No. 6,084,153, WO0164898, U.S. Pat. Nos. 6,177,275 and 6,107,547 (enhancement of nitrogen utilization and altered nitrogen responsiveness), herein incorporated by reference in their entirety. For ethylene alteration, see US Patent Application Publication Number 2004/0128719, US Patent Application Publication Number 2003/0166197 and WO200032761, herein incorporated by reference in their entirety. For plant transcription factors or transcriptional regulators of abiotic stress, see, e.g., US Patent Application Publication Number 2004/0098764 or US Patent Application Publication Number 2004/0078852, herein incorporated by reference in their entirety.

C. Other genes and transcription factors that affect plant growth and agronomic traits such as yield, flowering, plant growth and/or plant structure, can be introduced or introgressed into plants, see, e.g., WO97/49811 (LHY), WO98/56918 (ESD4), WO97/10339 and U.S. Pat. No. 6,573,430 (TFL), U.S. Pat. No. 6,713,663 (FT), WO96/14414 (CON), WO96/38560, WO01/21822 (VRN1), WO00/44918 (VRN2), WO99/49064 (GI), WO00/46358 (FM), WO97/29123, U.S. Pat. Nos. 6,794,560, 6,307,126 (GAI), WO99/09174 (D8 and Rht) and WO2004076638 and WO2004031349 (transcription factors), herein incorporated by reference in their entirety.

As used herein, "antisense orientation" includes reference to a polynucleotide sequence that is operably linked to a promoter in an orientation where the antisense strand is transcribed. The antisense strand is sufficiently complementary to an endogenous transcription product such that translation of the endogenous transcription product is often inhibited. "Operably linked" refers to the association of two or more nucleic acid fragments on a single nucleic acid fragment so that the function of one is affected by the other. For example, a promoter is operably linked with a coding sequence when it is capable of affecting the expression of that coding sequence (i.e., that the coding sequence is under the transcriptional control of the promoter). Coding sequences can be operably linked to regulatory sequences in sense or antisense orientation.

A heterologous nucleotide sequence operably linked to a promoter and its related biologically active fragments or variants useful in the methods disclosed herein may be an antisense sequence for a targeted gene. The terminology "antisense DNA nucleotide sequence" is intended to mean a sequence that is in inverse orientation to the 5'-to-3' normal orientation of that nucleotide sequence. When delivered into a plant cell, expression of the antisense DNA sequence prevents normal expression of the DNA nucleotide sequence for the targeted gene. The antisense nucleotide sequence encodes an RNA transcript that is complementary to and capable of hybridizing to the endogenous messenger RNA (mRNA) produced by transcription of the DNA nucleotide sequence for the targeted gene. In this case, production of the native protein encoded by the targeted gene is inhibited to achieve a desired phenotypic response. Modifications of the antisense sequences may be made as long as the sequences hybridize to and interfere with expression of the corresponding mRNA. In this manner, antisense constructions having 70%, 80%, 85% sequence identity to the corresponding antisense sequences may be used. Furthermore, portions of the antisense nucleotides may be used to disrupt the expression of the target gene. Generally, sequences of at least 50 nucleotides, 100 nucleotides, 200 nucleotides or greater may be used. Thus, a promoter may be operably linked to antisense DNA sequences to reduce or inhibit expression of a native protein in the plant when transformed by the methods disclosed herein.

"RNAi" refers to a series of related techniques to reduce the expression of genes (see, for example, U.S. Pat. No. 6,506,559, herein incorporated by reference in its entirety). Older techniques referred to by other names are now thought to rely on the same mechanism, but are given different names in the literature. These include "antisense inhibition," the production of antisense RNA transcripts capable of suppressing the expression of the target protein and "co-suppression" or "sense-suppression," which refer to the production of sense RNA transcripts capable of suppressing the expression of identical or substantially similar foreign or endogenous genes (U.S. Pat. No. 5,231,020, incorporated herein by reference in its entirety). Such techniques rely on the use of constructs resulting in the accumulation of double stranded RNA with one strand complementary to the target gene to be silenced.

As used herein, the terms "promoter" or "transcriptional initiation region" mean a regulatory region of DNA usually comprising a TATA box or a DNA sequence capable of directing RNA polymerase II to initiate RNA synthesis at the appropriate transcription initiation site for a particular coding sequence. A promoter may additionally comprise other recognition sequences generally positioned upstream or 5' to the TATA box or the DNA sequence capable of directing RNA polymerase II to initiate RNA synthesis, referred to as upstream promoter elements, which influence the transcription initiation rate.

The transcriptional initiation region, the promoter, may be native or homologous or foreign or heterologous to the host, or could be the natural sequence or a synthetic sequence. By foreign is intended that the transcriptional initiation region is not found in the wild-type host into which the transcriptional initiation region is introduced. Either a native or heterologous promoter may be used with respect to the coding sequence of interest.

The transcriptional (expression) cassette will include in the 5'-3' direction of transcription, a transcriptional and translational initiation region, a DNA sequence of interest/trait gene, and a transcriptional and translational termination region functional in plants. The termination region may be native with the transcriptional initiation region, may be native with the DNA sequence of interest, or may be derived from another source. Convenient termination regions are available from the potato proteinase inhibitor (PinII) gene or sequences from Ti-plasmid of *A. tumefaciens*, such as the nopaline synthase, octopine synthase and opaline synthase termination regions. See also, Guerineau et al., (1991) Mol. Gen. Genet. 262: 141-144; Proudfoot (1991) Cell 64: 671-674; Sanfacon et al. (1991) Genes Dev. 5: 141-149; Mogen et al. (1990) Plant Cell 2: 1261-1272; Munroe et al. (1990) Gene 91: 151-158; Ballas et al. 1989) Nucleic Acids Res. 17: 7891-7903; Joshi et al. (1987) Nucleic Acid Res. 15: 9627-9639.

The expression cassettes may additionally contain 5' leader sequences in the expression cassette construct. Such leader sequences can act to enhance translation. Translation leaders are known in the art and include: picornavirus leaders, for example, EMCV leader (Encephalomyocarditis 5'noncoding region) (Elroy-Stein, O., Fuerst, T. R., and Moss, B. (1989) PNAS USA, 86: 6126-6130); potyvirus leaders, for example, TEV leader (Tobacco Etch Virus) (Allison et al. (1986); MDMV leader (Maize Dwarf Mosaic Virus); Virology, 154: 9-20), and human immunoglobulin heavy-chain binding protein (BiP), (Macejak, D. G., and P. Sarnow (1991) Nature, 353: 90-94; untranslated leader from the coat protein MARNA of alfalfa mosaic virus (AMV RNA 4), (Jobling, S. A., and Gehrke, L., (1987) Nature, 325: 622-625; tobacco mosaic virus leader (TMV), (Gallie et al. (1989) Molecular Biology of RNA, pages 237-256, Gallie et al. (1987) Nucl. Acids Res. 15: 3257-3273; maize chlorotic mottle virus leader (MCMV) (Lornmel, S. A. et al. (1991) Virology, 81: 382-385). See also, Della-Cioppa et al. (1987) Plant Physiology, 84: 965-968; and endogenous maize 5' untranslated sequences. Other methods known to enhance translation and to enhance mRNA stability can also be utilized, for example, introns, such as the maize Ubiquitin intron (Christensen and Quail, (1996) Transgenic Res. 5:213-218; Christensen, et al., (1992) Plant Molecular Biology 18:675-689) or the maize AdhI intron (Kyozuka, et al., (1991) Mol. Gen. Genet. 228:40-48; Kyozuka, et al., (1990) Maydica 35:353-357) and the like, herein incorporated by reference in their entirety.

The expression cassettes may contain one or more than one gene or nucleic acid sequence to be transferred and expressed in the transformed plant. Thus, each nucleic acid sequence will be operably linked to 5' and 3' regulatory sequences. Alternatively, multiple expression cassettes may be provided.

In preparing expression cassettes useful in the methods of the disclosure, the various DNA fragments may be manipulated, to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, for example, transitions and transversions, may be involved.

The morphogenic genes and/or trait genes/polynucleotides of interest introduced into an explant by the disclosed methods can be operably linked to a suitable promoter. A "plant promoter" is a promoter capable of initiating transcription in plant cells whether or not its origin is a plant cell. Exemplary plant promoters include, but are not limited to, those that are obtained from plants, plant viruses, and bacteria which comprise genes expressed in plant cells such as from *Agrobacterium* or *Rhizobium*. Examples of promoters under developmental control include promoters that preferentially initiate transcription in certain tissues, such as leaves, roots, or seeds. Such promoters are referred to as "tissue preferred". Promoters which initiate transcription only in certain tissues are referred to as "tissue specific". A "cell type" specific promoter primarily drives expression in certain cell types in one or more organs, for example, vascular cells in roots or leaves. Tissue specific, tissue preferred, cell type specific, and inducible promoters constitute the class of "non-constitutive" promoters.

An "inducible" or "repressible" promoter can be a promoter which is under either environmental or exogenous control. Examples of environmental conditions that may affect transcription by inducible promoters include anaerobic conditions, or certain chemicals, or the presence of light. Alternatively, exogenous control of an inducible or repressible promoter can be affected by providing a suitable chemical or other agent that via interaction with target polypeptides result in induction or repression of the promoter. Inducible promoters include heat-inducible promoters, estradiol-responsive promoters, chemical inducible promoters, and the like. Pathogen inducible promoters include those from pathogenesis-related proteins (PR proteins), which are induced following infection by a pathogen; e. g., PR proteins, SAR proteins, beta-1,3-glucanase, chitinase, etc. See, for example, Redolfi et al. (1983) Neth. J. Plant Pathol. 89: 245-254; Uknes et al. (1992) The Plant Cell 4: 645-656; and Van Loon (1985) Plant Mol. Virol. 4: 111-116. Inducible promoters useful in the present methods include GLB1, OLE, LTP2, HSP17.7, HSP26, HSP18A, and XVE promoters.

A chemically-inducible promoter can be repressed by the tetracycline repressor (TETR), the ethametsulfuron repressor (ESR), or the chlorsulfuron repressor (CSR), and de-repression occurs upon addition of tetracycline-related or sulfonylurea ligands. The repressor can be TETR and the tetracycline-related ligand is doxycycline or anhydrotetracycline. (Gatz, C., Frohberg, C. and Wendenburg, R. (1992) Stringent repression and homogeneous de-repression by tetracycline of a modified CaMV 35S promoter in intact transgenic tobacco plants, Plant J. 2, 397-404). Alternatively, the repressor can be ESR and the sulfonylurea ligand is ethametsulfuron, chlorsulfuron, metsulfuron-methyl, sulfometuron methyl, chlorimuron ethyl, nicosulfuron, primisulfuron, tribenuron, sulfosulfuron, trifloxysulfuron, foramsulfuron, iodosulfuron, prosulfuron, thifensulfuron, rimsulfuron, mesosulfuron, or halosulfuron (US20110287936 incorporated herein by reference in its entirety). If the repressor is CSR, the CSR ligand is chlorsulfuron. See, U.S. Pat. No. 8,580,556 incorporated herein by reference in its entirety.

A "constitutive" promoter is a promoter which is active under most conditions. Promoters useful in the present disclosure include those disclosed in WO2017/112006 and those disclosed in U.S. Provisional Application 62/562,663. Constitutive promoters for use in expression of genes in plants are known in the art. Such promoters include, but are not limited to 35S promoter of cauliflower mosaic virus (Depicker et al. (1982) Mol. Appl. Genet. 1: 561-573; Odell et al. (1985) Nature 313: 810-812), ubiquitin promoter (Christensen et al. (1992) Plant Mol. Biol. 18: 675-689), promoters from genes such as ribulose bisphosphate carboxylase (De Almeida et al. (1989) Mol. Gen. Genet. 218: 78-98), actin (McElroy et al. (1990) Plant J. 2: 163-171), histone, DnaJ (Baszczynski et al. (1997) Maydica 42: 189-201), and the like. In various aspects, constitutive promoters useful in the methods of the disclosure include UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, and ZM-ADF PRO (ALT2) promoters.

Promoters useful in the present disclosure, listed in Table 4 below, include those disclosed in US Patent Application Publication Number 2017/0121722 and U.S. Pat. No. 8,710,206, herein incorporated by reference in their entirety.

TABLE 4

| Name | Description |
|---|---|
| ZM-PLTP | *Z. mays* PLTP promoter |
| SB-PLTP1 | *Sorghum biocolor* PLTP1 promoter |
| ZM-FBP1 | *Z. mays* promoter for Fructose-1,6-bisphosphatase |
| ZM-RFP | *Z. mays* promoter for NAD(P)-binding Rossmann-Fold Protein |
| ZM-APMP | *Z. mays* promoter for adipocyte plasma membrane-associated protein-like protein |
| ZM-RfeSP | *Z. mays* promoter for Rieske [2Fe-2S9 iron-sulphur domain protein |
| ZM-CRR6 | *Z. mays* promoter for Chlororespiratory reduction 6 gene |
| ZM-GLYK | *Z. mays* promoter for D-glycerate 3-kinase, chloroplastic-like protein gene |
| ZM-CAB7 | *Z. mays* promoter for Chlorophyll a-b binding protein 7, chloroplastic-like protein |
| ZM-UBR | *Z. mays* promoter for Ultraviolet-B-repressible protein gene |
| ZM-HBP | *Z. mays* promoter for Soul heme-binding family protein |
| ZM-PSAN | *Z. mays* promoter for Photosystem I reaction center subunit psi-N |
| ZM-SDR | *Z. mays* promoter for Short-chain dehydrogenase/reductase |
| AXIG1 | AXIG1 promoter |
| DR5 | DR5 promoter |
| ZM-PLTP1 | *Z. mays* PLTP1 promoter |
| ZM-PLTP2 | *Z. mays* PLTP2 promoter |
| SB-PLTP2 | *Sorghum biocolor* PLTP2 promoter |
| SB-PLTP3 | *Sorghum biocolor* PLTP3 promoter |
| SI-PLTP1 | *Setaria italica* PLTP promoter |
| OS-PLTP1 | *Oryza sativa* PLTP promoter e |
| OS-PLTP2 | *Oryza sativa* PLTP2 promoter |
| ZM-LGL PRO | *Z. mays* promoter for the lactoylglutathione lyase gene |
| ZM-LEA14-A PRO | *Z. mays* promoter for gene encoding late embryogenic abundant protein Lea-14-A |
| ZM-LEA34-D PRO | *Z. mays* promoter for gene encoding late embryogenic abundant protein Lea34-D |

TABLE 4-continued

| Name | Description |
|---|---|
| ZM-SDR PRO (long) | *Z. mays* promoter for the short-chain dehydrogenase/reductase (long) |
| OS-SDR PRO | *O. sativa* promoter for the short-chain dehydrogenase/reductase |
| SB-SDR PRO | *S. bicolor* promoter for the short-chain dehydrogenase/reductase |
| GM-EF1A PRO | *Glycine max* EF1A promoter |

Additional promoters useful in the methods of the disclosure are listed in Table 5 below.

TABLE 5

| SEQ ID NO: | Promoter Name | Description |
|---|---|---|
| 35 | GM-HBSTART3 | *Glycine max* HB START3 (Homeodomain StAR-related lipid transfer3) promoter sequence |
| 36 | GM-HBSTART3 (TRUNCATED) | *Glycine max* HB START3 (Homeodomain StAR-related lipid transfer3) promoter sequence (TRUNCATED) |
| 37 | AT-ML1 | *Arabidopsis thaliana* ML1 (MERISTEM LAYER1) promoter sequence |
| 38 | GM-ML1-Like | *Glycine max* ML1-Like (MERISTEM LAYER1-Like) promoter sequence |
| 39 | GM-ML1-Like (TRUNCATED) | *Glycine max* ML1-Like (MERISTEM LAYER1-Like) promoter sequence (TRUNCATED) |
| 40 | ZM-HBSTART3 | *Zea mays* HB START3 (Homeodomain StAR-related lipid transfer3) promoter sequence |
| 41 | OS-HBSTART3 | *Oryza sativa* HB START3 (Homeodomain StAR-related lipid transfer3) promoter sequence |
| 42 | AT-PDF1 | *Arabidopsis thaliana* PDF1 (PROTODERMAL FACTOR1) promoter sequence |
| 43 | GM-PDF1 | *Glycine max* PDF1 (PROTODERMAL FACTOR1) promoter sequence |
| 44 | GM-PDF1 (TRUNCATED) | *Glycine max* PDF1 (PROTODERMAL FACTOR1) promoter sequence (TRUNCATED) |
| 45 | SB-PDF1 | *Sorghum bicolor* PDF1 (PROTODERMAL FACTOR1) promoter sequence |
| 46 | OS-PDF1 | *Oryza sativa* PDF1 (PROTODERMAL FACTOR1) promoter sequence |
| 47 | OS-PDF1 (TRUNCATED) | *Oryza sativa* PDF1 (PROTODERMAL FACTOR1) promoter sequence (TRUNCATED) |
| 48 | PT-PDF1 | *Populus trichocarpa* PDF1 (PROTODERMAL FACTOR1) promoter sequence |
| 49 | PT-PDF1 (TRUNCATED) | *Populus trichocarpa* PDF1 (PROTODERMAL FACTOR1) promoter sequence (TRUNCATED) |
| 50 | SI-PDF1 | *Setaria italica* PDF1 (PROTODERMAL FACTOR1) promoter sequence |
| 51 | SI-PDF1 (TRUNCATED) | *Setaria italica* PDF1 (PROTODERMAL FACTOR1) promoter sequence (TRUNCATED) |
| 52 | AT-PDF2 | *Arabidopsis thaliana* PDF2 (PROTODERMAL FACTOR2) promoter sequence |
| 53 | GM-PDF2 | *Glycine max* PDF2 (PROTODERMAL FACTOR2) promoter sequence |
| 54 | GM-PDF2 (TRUNCATED) | *Glycine max* PDF2 (PROTODERMAL FACTOR2) promoter sequence (TRUNCATED) |
| 55 | ZM-GL1 | *Zea mays* GL1 (GLABROUS1) promoter sequence |
| 56 | AT-PDF2a | *Arabidopsis thaliana* PDF2a (PROTODERMAL FACTOR2a) promoter sequence |
| 57 | AT-PDF2a (TRUNCATED) | *Arabidopsis thaliana* PDF2a (PROTODERMAL FACTOR2a) promoter sequence (TRUNCATED) |
| 58 | GM-PDF2a | *Glycine max* PDF2a (PROTODERMAL FACTOR2a) promoter sequence |
| 59 | GM-PDF2a (TRUNCATED) | *Glycine max* PDF2a (PROTODERMAL FACTOR2a) promoter sequence (TRUNCATED) |
| 60 | OS-PDF2 | *Oryza sativa* PDF2 (PROTODERMAL FACTOR2) promoter sequence |
| 61 | OS-PDF2 (TRUNCATED) | *Oryza sativa* PDF2 (PROTODERMAL FACTOR2) promoter sequence (TRUNCATED) |
| 62 | PT-PDF2 | *Populus trichocarpa* PDF2 (PROTODERMAL FACTOR2) promoter sequence) |

TABLE 5-continued

| SEQ ID NO: | Promoter Name | Description |
|---|---|---|
| 63 | PT-PDF2 (TRUNCATED) | *Populus trichocarpa* PDF2 (PROTODERMAL FACTOR2) promoter sequence (TRUNCATED) |
| 64 | VV-PDF2 | *Vitus vinifera* PDF2 (PROTODERMAL FACTOR2) promoter sequence |
| 65 | VV-PDF2 (TRUNCATED) | *Vitus vinifera* PDF2 (PROTODERMAL FACTOR2) promoter sequence (TRUNCATED) |
| 66 | ZM-PDF2 | *Zea mays* PDF2 (PROTODERMAL FACTOR2) promoter sequence |
| 67 | SI-PDF2 | *Setaria italica* PDF2 (PROTODERMAL FACTOR2) promoter sequence |
| 68 | SI-PDF2 (TRUNCATED) | *Setaria italica* PDF2 (PROTODERMAL FACTOR2) promoter sequence(TRUNCATED) |
| 69 | VV-PDF2a | *Vitus vinifera* PDF2a (PROTODERMAL FACTOR2a) promoter sequence |
| 70 | PT-PDF2a | *Populus trichocarpa* PDF2a (PROTODERMAL FACTOR2a) promoter sequence |
| 71 | PT-PDF2a (TRUNCATED) | *Populus trichocarpa* PDF2a (PROTODERMAL FACTOR2a) promoter sequence (TRUNCATED) |
| 72 | MT-PDF2 | *Medicago trunculata* PDF2 (PROTODERMAL FACTOR2) promoter sequence |
| 73 | MT-PDF2 (TRUNCATED) | *Medicago trunculata* PDF2 (PROTODERMAL FACTOR2) promoter sequence (TRUNCATED) |
| 74 | AT-HDG2 | *Arabidopsis thaliana* HDG2 (HOMEODOMAIN GLABROUS2) promoter sequence |
| 75 | GM-HDG2 | *Glycine max* HDG2 (HOMEODOMAIN GLABROUS2) promoter sequence |
| 76 | GM-HDG2 (TRUNCATED) | *Glycine max* HDG2 (HOMEODOMAIN GLABROUS2) promoter sequence (TRUNCATED) |
| 77 | SB-HDG2 | *Sorghum bicolor* HDG2 (HOMEODOMAIN GLABROUS2) promoter sequence |
| 78 | SB-HDG2 (TRUNCATED) | *Sorghum bicolor* HDG2 (HOMEODOMAIN GLABROUS2) promoter sequence (TRUNCATED) |
| 79 | AT-CER6 | *Arabidopsis thaliana* CER6 (ECERIFERUM6) promoter sequence |
| 80 | AT-CER60 | *Arabidopsis thaliana* CER60 (ECERIFERUM60) promoter sequence |
| 81 | AT-CER60 (TRUNCATED) | *Arabidopsis thaliana* CER60 (ECERIFERUM60) promoter sequence (TRUNCATED) |
| 82 | GM-CER6 | *Glycine max* CER6 (ECERIFERUM6) promoter sequence |
| 83 | GM-CER6 (TRUNCATED) | *Glycine max* CER6 (ECERIFERUM6) promoter sequence (TRUNCATED) |
| 84 | PT-CER6 | *Populus trichocarpa* CER6 (ECERIFERUM6) promoter sequence |
| 85 | PT-CER6 (TRUNCATED) | *Populus trichocarpa* CER6 (ECERIFERUM6) promoter sequence (TRUNCATED) |
| 86 | VV-CER6 | *Vitus vinifera* CER6 (ECERIFERUM6) promoter sequence |
| 87 | VV-CER6 (TRUNCATED) | *Vitus vinifera* CER6 (ECERIFERUM6) promoter sequence (TRUNCATED) |
| 88 | SB-CER6 | *Sorghum bicolor* CER6 (ECERIFERUM6) promoter sequence |
| 89 | ZM-CER6 | *Zea mays* CER6 (ECERIFERUM6) promoter sequence |
| 90 | SI-CER6 | *Setaria italica* CER6 (ECERIFERUM6) promoter sequence |
| 91 | SI-CER6 (TRUNCATED) | *Setaria italica* CER6 (ECERIFERUM6) promoter sequence (TRUNCATED) |

TABLE 5-continued

| SEQ ID NO: | Promoter Name | Description |
|---|---|---|
| 92 | OS-CER6 | *Oryza sativa* CER6 (ECERIFERUM6) promoter sequence |
| 93 | OS-CER6 (TRUNCATED) | *Oryza sativa* CER6 (ECERIFERUM6) promoter sequence (TRUNCATED) |
| 94 | GM-HBSTART2 | *Glycine max* HB START2 (Homeodomain StAR-related lipid transfer2) promoter sequence |
| 95 | GM-MATE1 | *Glycine max* MATE1 (Multi-antimicrobial extrusion protein 1) promoter sequence |
| 96 | GM-NED1 | *Glycine max* NED1 (NAD dependent epimerase/dehydratasel) promoter sequence |
| 97 | GM-LTP3 | *Glycine max* LTP3 (Lipid Transfer Protein3) promoter sequence |
| 98 | SB-GL1 | *Sorghum bicolor* GL1 (GLABROUS1) promoter sequence |
| 99 | OS-GL1 | *Oryza sativa* GL1 (GLABROUS1) promoter sequence |
| 100 | AT-GL1 | *Arabidopsis thaliana* GL1 (GLABROUS1) promoter sequence |
| 101 | GM-GL1 | *Glycine max* GL1 (GLABROUS1) promoter sequence |
| 102 | AT-ANL1 | *Arabidopsis thaliana* ANL1 (ANTHOCYANLESS1) promoter sequence |
| 103 | ZM-OCL1 | *Zea mays* OCL1 (OUTER CELL LAYER1) promoter sequence |
| 104 | OS-OCL1 | *Oryza sativa* OCL1 (OUTER CELL LAYER1) promoter sequence |

As used herein, the term "regulatory element" also refers to a sequence of DNA, usually, but not always, upstream (5') to the coding sequence of a structural gene, which includes sequences which control the expression of the coding region by providing the recognition for RNA polymerase and/or other factors required for transcription to start at a particular site. An example of a regulatory element that provides for the recognition for RNA polymerase or other transcriptional factors to ensure initiation at a particular site is a promoter element. A promoter element comprises a core promoter element, responsible for the initiation of transcription, as well as other regulatory elements that modify gene expression. It is to be understood that nucleotide sequences, located within introns or 3' of the coding region sequence may also contribute to the regulation of expression of a coding region of interest. Examples of suitable introns include, but are not limited to, the maize IVS6 intron, or the maize actin intron. A regulatory element may also include those elements located downstream (3') to the site of transcription initiation, or within transcribed regions, or both. In the context of the methods of the disclosure a post-transcriptional regulatory element may include elements that are active following transcription initiation, for example translational and transcriptional enhancers, translational and transcriptional repressors and mRNA stability determinants.

A "heterologous nucleotide sequence", "heterologous polynucleotide of interest", "heterologous polynucleotide", or "heterologous trait gene" as used throughout the disclosure, is a sequence that is not naturally occurring with or operably linked to a promoter. While this nucleotide sequence or trait gene is heterologous to the promoter sequence, it may be homologous or native or heterologous or foreign to the plant host. Likewise, the promoter sequence may be homologous or native or heterologous or foreign to the plant host and/or the polynucleotide of interest.

The DNA constructs/expression cassettes useful in the methods of the disclosure can also include further enhancers, either translation or transcription enhancers, as may be required. These enhancer regions are well known to persons skilled in the art, and can include the ATG initiation codon and adjacent sequences. The initiation codon must be in phase with the reading frame of the coding sequence to ensure translation of the entire sequence. The translation control signals and initiation codons can be from a variety of origins, both natural and synthetic. Translational initiation regions may be provided from the source of the transcriptional initiation region, or from the structural gene. The sequence can also be derived from the regulatory element selected to express the gene, and can be specifically modified to increase translation of the mRNA. It is recognized that to increase transcription levels enhancers may be utilized in combination with promoter regions. It is recognized that to increase transcription levels, enhancers may be utilized in combination with promoter regions. Enhancers are nucleotide sequences that act to increase the expression of a promoter region. Enhancers are known in the art and include the SV40 enhancer region, the 35S enhancer element and the like. Some enhancers are also known to alter normal promoter expression patterns, for example, by causing a promoter to be expressed constitutively when without the enhancer, the same promoter is expressed only in one specific tissue or a few specific tissues. Enhancers useful in the methods of the disclosure are listed in Table 6 below.

TABLE 6

| SEQ ID NO: | Description |
|---|---|
| 142 | CaMV35S Enhancer (CAMV35S ENH) |
| 143 | Citrus Yellow Mosaic Virus Enhancer (CYMV ENH) |
| 144 | Banana Streak Virus Enhancer (BSV(AY) ENH) |
| 145 | Figwort Mosaic Virus Enhancer (FMV ENH) |
| 146 | Peanut Chlorotic Streak Virus Enhancer (PCSV ENH) |
| 147 | Mirabilis Mosaic Virus Enhancer (MMV ENH) |

Generally, a "weak promoter" means a promoter that drives expression of a coding sequence at a low level. A "low level" of expression is intended to mean expression at levels of about 1/10,000 transcripts to about 1/100,000 transcripts to about 1/500,000 transcripts. Conversely, a strong promoter drives expression of a coding sequence at a high level, or at about 1/10 transcripts to about 1/100 transcripts to about 1/1,000 transcripts.

It is recognized that sequences useful in the methods of the disclosure may be used with their native coding sequences thereby resulting in a change in phenotype of the transformed plant. The morphogenic genes and genes of interest disclosed herein, as well as variants and fragments thereof, are useful in the methods of the disclosure for the genetic manipulation of any plant. The term "operably linked" means that the transcription or translation of a heterologous nucleotide sequence is under the influence of a promoter sequence.

In one aspect of the disclosure, expression cassettes comprise a transcriptional initiation region or variants or fragments thereof, operably linked to a morphogenic gene and/or a heterologous nucleotide sequence. Such expression cassettes can be provided with a plurality of restriction sites for insertion of the nucleotide sequence to be under the transcriptional regulation of the regulatory regions. The expression cassettes may additionally contain selectable marker genes as well as 3' termination regions.

The expression cassettes can include, in the 5'-3' direction of transcription, a transcriptional initiation region (i.e., a promoter, or variant or fragment thereof), a translational initiation region, a morphogenic gene and/or a heterologous nucleotide sequence of interest, a translational termination region and optionally, a transcriptional termination region functional in the host organism. The regulatory regions (i.e., promoters, transcriptional regulatory regions, and translational termination regions), the morphogenic gene and/or the polynucleotide of interest useful in the methods of the disclosure may be native/analogous to the host cell or to each other. Alternatively, the regulatory regions, morphogenic gene and/or the polynucleotide of interest may be heterologous to the host cell or to each other. As used herein, "heterologous" in reference to a sequence is a sequence that originates from a foreign species or, if from the same species, is substantially modified from its native form in composition and/or genomic locus by deliberate human intervention. For example, a promoter operably linked to a heterologous polynucleotide is from a species different from the species from which the polynucleotide was derived or, if from the same/analogous species, one or both are substantially modified from their original form and/or genomic locus or the promoter is not the native promoter for the operably linked polynucleotide.

The termination region may be native with the transcriptional initiation region, may be native with the operably linked morphogenic gen and/or may be native with the operably linked DNA sequence of interest, may be native with the plant host, or may be derived from another source (i.e., foreign or heterologous to the promoter, the morphogenic gene and/or the DNA sequence being expressed, the plant host, or any combination thereof). Convenient termination regions are available from the Ti-plasmid of *A. tumefaciens*, such as the octopine synthase and nopaline synthase termination regions. See also, Guerineau, et al., (1991) Mol. Gen. Genet. 262:141-144; Proudfoot, (1991) Cell 64:671-674; Sanfacon, et al., (1991) Genes Dev. 5:141-149; Mogen, et al., (1990) Plant Cell 2:1261-1272; Munroe, et al., (1990) Gene 91:151-158; Ballas, et al., (1989) Nucleic Acids Res. 17:7891-7903; and Joshi, et al., (1987) Nucleic Acid Res. 15:9627-9639, herein incorporated by reference in their entirety.

The expression cassette comprising a promoter operably linked to a morphogenic gene and/or optionally further operably linked to a heterologous nucleotide sequence, a heterologous polynucleotide of interest, a heterologous polynucleotide nucleotide, a sequence of interest, or a trait gene can be used to transform any plant. Alternatively, a heterologous polynucleotide of interest, a heterologous polynucleotide nucleotide, a sequence of interest, or a trait gene operably linked to a promoter can be on a separate expression cassette positioned outside of the transfer-DNA (T-DNA). In this manner, genetically modified plants, plant cells, plant tissue, seed, root and the like can be obtained. The expression cassette comprising the sequences of the present disclosure may also contain at least one additional nucleotide sequence for a gene, heterologous nucleotide sequence, heterologous polynucleotide of interest, or heterologous polynucleotide to be cotransformed into the organism. Alternatively, the additional nucleotide sequence(s) can be provided on another expression cassette.

Where appropriate, the nucleotide sequences/trait genes whose expression is to be under the control a promoter sequence and any additional nucleotide sequence(s) may be optimized for increased expression in the transformed plant. That is, these nucleotide sequences can be synthesized using plant preferred codons for improved expression. See, for example, Campbell and Gowri, (1990) Plant Physiol. 92:1-11, herein incorporated by reference in its entirety, for a discussion of host-preferred codon usage. Methods are available in the art for synthesizing plant-preferred genes. See, for example, U.S. Pat. Nos. 5,380,831, 5,436,391 and Murray, et al., (1989) Nucleic Acids Res. 17:477-498, herein incorporated by reference in their entirety.

Additional sequence modifications are known to enhance gene expression in a cellular host. These include elimination of sequences encoding spurious polyadenylation signals, exon-intron splice site signals, transposon-like repeats and other such well-characterized sequences that may be deleterious to gene expression. The G-C content of a heterologous nucleotide sequence may be adjusted to levels average for a given cellular host, as calculated by reference to known genes expressed in the host cell. When possible, the sequence is modified to avoid predicted hairpin secondary mRNA structures.

As used herein, "vector" refers to a DNA molecule such as a plasmid, cosmid or bacterial phage for introducing a nucleotide construct, for example, an expression cassette, into a host cell. Cloning vectors typically contain one or a small number of restriction endonuclease recognition sites at which foreign DNA sequences can be inserted in a determinable fashion without loss of essential biological function of the vector, as well as a marker gene that is suitable for use in the identification and selection of cells transformed with the cloning vector. Marker genes typically include genes that provide tetracycline resistance, hygromycin resistance or ampicillin resistance.

Cells that have been transformed may be grown into plants in accordance with conventional ways. See, for example, McCormick, et al., (1986) Plant Cell Reports 5:81-84, herein incorporated by reference in its entirety. These plants may then be grown, and either pollinated with the same transformed strain or different strains, and the resulting progeny having expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present disclosure provides transformed seed (also referred to as "transgenic seed") having a nucleotide construct useful in the methods of the disclosure, for example, an expression cassette useful in the methods of the disclosure, stably incorporated into its genome.

There are a variety of methods for the regeneration of plants from plant tissue. The particular method of regeneration will depend on the starting plant tissue and the particular plant species to be regenerated. The regeneration, development and cultivation of plants from single plant protoplast transformants or from various transformed explants is well known in the art (Weissbach and Weissbach, (1988) In: Methods for Plant Molecular Biology, (Eds.), Academic Press, Inc., San Diego, Calif., herein incorporated by reference in its entirety). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant produced by the methods of the disclosure containing a desired polynucleotide of interest is cultivated using methods well known to one skilled in the art.

Methods are known in the art for the targeted insertion of a polynucleotide at a specific location in the plant genome. The insertion of the polynucleotide at a desired genomic location is achieved using a site-specific recombination system. See, for example, WO99/25821, WO99/25854, WO99/25840, WO99/25855 and WO99/25853, all of which are herein incorporated by reference in their entirety. Briefly, a polynucleotide of interest, flanked by two non-identical recombination sites, can be contained in a T-DNA transfer cassette. The T-DNA transfer cassette is introduced into a plant having stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

The disclosed methods can be used to introduce into explants polynucleotides that are useful to target a specific site for modification in the genome of a plant derived from the explant. Site specific modifications that can be introduced with the disclosed methods include those produced using any method for introducing site specific modification, including, but not limited to, through the use of gene repair oligonucleotides (e.g. US Publication 2013/0019349), or through the use of double-stranded break technologies such as TALENs, meganucleases, zinc finger nucleases, CRISPR-Cas, and the like. For example, the disclosed methods can be used to introduce a CRISPR-Cas system into a plant cell or plant, for the purpose of genome modification of a target sequence in the genome of a plant or plant cell, for selecting plants, for deleting a base or a sequence, for gene editing, and for inserting a polynucleotide of interest into the genome of a plant or plant cell. Thus, the disclosed methods can be used together with a CRISPR-Cas system to provide for an effective system for modifying or altering target sites and nucleotides of interest within the genome of a plant, plant cell or seed. The Cas endonuclease gene is a plant optimized Cas9 endonuclease, wherein the plant optimized Cas9 endonuclease is capable of binding to and creating a double strand break in a genomic target sequence of the plant genome.

The Cas endonuclease is guided by the guide nucleotide to recognize and optionally introduce a double strand break at a specific target site into the genome of a cell. The CRISPR-Cas system provides for an effective system for modifying target sites within the genome of a plant, plant cell or seed. Further provided are methods employing a guide polynucleotide/Cas endonuclease system to provide an effective system for modifying target sites within the genome of a cell and for editing a nucleotide sequence in the genome of a cell. Once a genomic target site is identified, a variety of methods can be employed to further modify the target sites such that they contain a variety of polynucleotides of interest. The disclosed methods can be used to introduce a CRISPR-Cas system for editing a nucleotide sequence in the genome of a cell. The nucleotide sequence to be edited (the nucleotide sequence of interest) can be located within or outside a target site that is recognized by a Cas endonuclease.

CRISPR loci (Clustered Regularly Interspaced Short Palindromic Repeats) (also known as SPIDRs-SPacer Interspersed Direct Repeats) constitute a family of recently described DNA loci. CRISPR loci consist of short and highly conserved DNA repeats (typically 24 to 40 bp, repeated from 1 to 140 times—also referred to as CRISPR-repeats) which are partially palindromic. The repeated sequences (usually specific to a species) are interspaced by variable sequences of constant length (typically 20 to 58 by depending on the CRISPR locus (WO2007/025097 published Mar. 1, 2007).

CRISPR loci were first recognized in *E. coli* (Ishino et al. (1987) J. Bacterial. 169:5429-5433; Nakata et al. (1989) J. Bacterial. 171:3553-3556). Similar interspersed short sequence repeats have been identified in *Haloferax mediterranei, Streptococcus pyogenes, Anabaena*, and *Mycobacterium tuberculosis* (Groenen et al. (1993) Mol. Microbiol. 10:1057-1065; Hoe et al. (1999) Emerg. Infect. Dis. 5:254-263; Masepohl et al. (1996) Biochim. Biophys. Acta 1307: 26-30; Mojica et al. (1995) Mol. Microbiol. 17:85-93). The CRISPR loci differ from other SSRs by the structure of the repeats, which have been termed short regularly spaced repeats (SRSRs) (Janssen et al. (2002) OMICS J. Integ. Biol. 6:23-33; Mojica et al. (2000) Mol. Microbiol. 36:244-246). The repeats are short elements that occur in clusters, that are always regularly spaced by variable sequences of constant length (Mojica et al. (2000) Mol. Microbiol. 36:244-246).

Cas gene includes a gene that is generally coupled, associated or close to or in the vicinity of flanking CRISPR loci. The terms "Cas gene" and "CRISPR-associated (Cas) gene" are used interchangeably herein. A comprehensive review of the Cas protein family is presented in Haft et al. (2005) Computational Biology, PLoS Comput Biol 1 (6): e60. doi:10.1371/journal.pcbi.0010060.

In addition to the four initially described gene families, an additional 41 CRISPR-associated (Cas) gene families have been described in US Patent Application Publication Number 2015/0059010, which is incorporated herein by reference. This reference shows that CRISPR systems belong to different classes, with different repeat patterns, sets of genes, and species ranges. The number of Cas genes at a given CRISPR locus can vary between species. Cas endonuclease relates to a Cas protein encoded by a Cas gene, wherein the Cas protein is capable of introducing a double strand break into a DNA target sequence. The Cas endonuclease is guided by the guide polynucleotide to recognize and optionally introduce a double strand break at a specific target site into the genome of a cell. As used herein, the term "guide polynucleotide/Cas endonuclease system" includes a complex of a Cas endonuclease and a guide polynucleotide that is capable of introducing a double strand break into a DNA target sequence. The Cas endonuclease unwinds the DNA duplex in close proximity of the genomic target site and cleaves both DNA strands upon recognition of a target sequence by a guide nucleotide, but only if the correct protospacer-adjacent motif (PAM) is approximately oriented at the 3' end of the target sequence (see FIG. 2A and FIG. 2B of US Patent Application Publication Number 2015/0059010).

In an aspect, the Cas endonuclease gene is a Cas9 endonuclease, such as, but not limited to, Cas9 genes listed in SEQ ID NOs: 462, 474, 489, 494, 499, 505, and 518 of WO2007/025097, published Mar. 1, 2007, and incorporated herein by reference. In another aspect, the Cas endonuclease gene is plant, maize or soybean optimized Cas9 endonuclease, such as, but not limited to those shown in FIG. 1A of US Patent Application Publication Number 2015/0059010.

In another aspect, the Cas endonuclease gene is operably linked to a SV40 nuclear targeting signal upstream of the Cas codon region and a bipartite VirD2 nuclear localization signal (Tinland et al. (1992) Proc. Natl. Acad. Sci. USA 89:7442-6) downstream of the Cas codon region.

In an aspect, the Cas endonuclease gene is a Cas9 endonuclease gene of SEQ ID NO:1, 124, 212, 213, 214, 215, 216, 193 or nucleotides 2037-6329 of SEQ ID NO:5, or any functional fragment or variant thereof, of US Patent Application Publication Number 2015/0059010.

As related to the Cas endonuclease, the terms "functional fragment," "fragment that is functionally equivalent," and "functionally equivalent fragment" are used interchangeably herein. These terms refer to a portion or subsequence of the Cas endonuclease sequence in which the ability to create a double-strand break is retained.

As related to the Cas endonuclease, the terms "functional variant," "variant that is functionally equivalent" and "functionally equivalent variant" are used interchangeably herein. These terms refer to a variant of the Cas endonuclease in which the ability to create a double-strand break is retained. Fragments and variants can be obtained via methods such as site-directed mutagenesis and synthetic construction.

In an aspect, the Cas endonuclease gene is a plant codon optimized *Streptococcus pyogenes* Cas9 gene that can recognize any genomic sequence of the form N(12-30)NGG which can in principle be targeted.

Endonucleases are enzymes that cleave the phosphodiester bond within a polynucleotide chain, and include restriction endonucleases that cleave DNA at specific sites without damaging the bases. Restriction endonucleases include Type I, Type II, Type III, and Type IV endonucleases, which further include subtypes. In the Type I and Type III systems, both the methylase and restriction activities are contained in a single complex. Endonucleases also include meganucleases, also known as homing endonucleases (HEases), which like restriction endonucleases, bind and cut at a specific recognition site, however the recognition sites for meganucleases are typically longer, about 18 bp or more (Patent application PCT/US 12/30061 filed on Mar. 22, 2012). Meganucleases have been classified into four families based on conserved sequence motifs, the families are the LAGLIDADG, GIY-YIG, H-N-H, and His-Cys box families. These motifs participate in the coordination of metal ions and hydrolysis of phosphodiester bonds. Meganucleases are notable for their long recognition sites, and for tolerating some sequence polymorphisms in their DNA substrates. The naming convention for meganuclease is similar to the convention for other restriction endonuclease. Meganucleases are also characterized by prefix F-, I-, or PI—for enzymes encoded by free-standing ORFs, introns, and inteins, respectively. One step in the recombination process involves polynucleotide cleavage at or near the recognition site. This cleaving activity can be used to produce a double-strand break. For reviews of site-specific recombinases and their recognition sites, see, Sauer (1994) Curr Op Biotechnol 5:521-7; and Sadowski (1993) FASEB 7:760-7. In some examples the recombinase is from the Integrase or Resolvase families. TAL effector nucleases are a new class of sequence-specific nucleases that can be used to make double-strand breaks at specific target sequences in the genome of a plant or other organism. (Miller, et al. (2011) Nature Biotechnology 29:143-148). Zinc finger nucleases (ZFNs) are engineered double-strand break inducing agents comprised of a zinc finger DNA binding domain and a double-strand-break-inducing agent domain. Recognition site specificity is conferred by the zinc finger domain, which typically comprising two, three, or four zinc fingers, for example having a C2H2 structure, however other zinc finger structures are known and have been engineered. Zinc finger domains are amenable for designing polypeptides which specifically bind a selected polynucleotide recognition sequence. ZFNs include an engineered DNA-binding zinc finger domain linked to a nonspecific endonuclease domain, for example nuclease domain from a Type Ms endonuclease such as Fokl. Additional functionalities can be fused to the zinc-finger binding domain, including transcriptional activator domains, transcription repressor domains, and methylases. In some examples, dimerization of nuclease domain is required for cleavage activity. Each zinc finger recognizes three consecutive base pairs in the target DNA. For example, a 3 finger domain recognized a sequence of 9 contiguous nucleotides, with a dimerization requirement of the nuclease, two sets of zinc finger triplets are used to bind an 18 nucleotide recognition sequence.

A "Dead-CAS9" (dCAS9) as used herein, is used to supply a transcriptional repressor domain. The dCAS9 has been mutated so that can no longer cut DNA. The dCAS0 can still bind when guided to a sequence by the gRNA and can also be fused to repressor elements (see Gilbert et al., *Cell* 2013 Jul. 18; 154(2): 442-451, Kiani et al., 2015 November *Nature Methods* Vol. 12 No. 11: 1051-1054). The dCAS9 fused to the repressor element, as described herein, is abbreviated to dCAS9~REP, where the repressor element (REP) can be any of the known repressor motifs that have been characterized in plants (see Kagale and Rozxadowski, 20010 *Plant Signaling & Behavior* 5:6, 691-694 for review). An expressed guide RNA (gRNA) binds to the dCAS9~REP protein and targets the binding of the dCAS9-REP fusion protein to a specific predetermined nucleotide sequence within a promoter (a promoter within the T-DNA). For example, if this is expressed beyond-the border using a ZM-UBI PRO::dCAS9~REP::PINII TERM cassette along with a U6-POL PRO::gRNA::U6 TERM cassette and the gRNA is designed to guide the dCAS9-REP protein to bind the SB-UBI promoter in the expression cassette SB-UBI PRO::moPAT::PINII TERM within the T-DNA, any event that has integrated the beyond-the-border sequence would be bialaphos sensitive.

Transgenic events that integrate only the T-DNA would express moPAT and be bialaphos resistant. The advantage of using a dCAS9 protein fused to a repressor (as opposed to a TETR or ESR) is the ability to target these repressors to any promoter within the T-DNA. TETR and ESR are restricted to cognate operator binding sequences. Alternatively, a synthetic Zinc-Finger Nuclease fused to a repressor domain can be used in place of the gRNA and dCAS9~REP (Urritia et al., 2003, Genome Biol. 4:231) as described above.

Bacteria and archaea have evolved adaptive immune defenses termed clustered regularly interspaced short palindromic repeats (CRISPR)/CRISPR-associated (Cas) systems that use short RNA to direct degradation of foreign nucleic acids ((WO2007/025097 published Mar. 1, 2007). The type II CRISPR/Cas system from bacteria employs a crRNA and tracrRNA to guide the Cas endonuclease to its DNA target. The crRNA (CRISPR RNA) contains the region complementary to one strand of the double strand DNA target and base pairs with the tracrRNA (trans-activating CRISPR RNA) forming a RNA duplex that directs the Cas endonuclease to cleave the DNA target.

As used herein, the term "guide nucleotide" relates to a synthetic fusion of two RNA molecules, a crRNA (CRISPR RNA) comprising a variable targeting domain, and a tracrRNA. In an aspect, the guide nucleotide comprises a variable targeting domain of 12 to 30 nucleotide sequences and a RNA fragment that can interact with a Cas endonuclease.

As used herein, the term "guide polynucleotide" relates to a polynucleotide sequence that can form a complex with a Cas endonuclease and enables the Cas endonuclease to recognize and optionally cleave a DNA target site. The guide polynucleotide can be a single molecule or a double molecule. The guide polynucleotide sequence can be a RNA sequence, a DNA sequence, or a combination thereof (a RNA-DNA combination sequence). Optionally, the guide polynucleotide can comprise at least one nucleotide, phosphodiester bond or linkage modification such as, but not limited, to Locked Nucleic Acid (LNA), 5-methyl dC, 2,6-Diaminopurine, 2'-Fluoro A, 2'-Fluoro U, 2'-O-Methyl RNA, phosphorothioate bond, linkage to a cholesterol molecule, linkage to a polyethylene glycol molecule, linkage to a spacer 18 (hexaethylene glycol chain) molecule, or 5' to 3' covalent linkage resulting in circularization. A guide polynucleotide that solely comprises ribonucleic acids is also referred to as a "guide nucleotide".

The guide polynucleotide can be a double molecule (also referred to as duplex guide polynucleotide) comprising a first nucleotide sequence domain (referred to as Variable Targeting domain or VT domain) that is complementary to a nucleotide sequence in a target DNA and a second nucleotide sequence domain (referred to as Cas endonuclease recognition domain or CER domain) that interacts with a Cas endonuclease polypeptide. The CER domain of the double molecule guide polynucleotide comprises two separate molecules that are hybridized along a region of complementarity. The two separate molecules can be RNA, DNA, and/or RNA-DNA-combination sequences. In an aspect, the first molecule of the duplex guide polynucleotide comprising a VT domain linked to a CER domain is referred to as "crDNA" (when composed of a contiguous stretch of DNA nucleotides) or "crRNA" (when composed of a contiguous stretch of RNA nucleotides), or "crDNA-RNA" (when composed of a combination of DNA and RNA nucleotides). The crNucleotide can comprise a fragment of the cRNA naturally occurring in Bacteria and Archaea. In an aspect, the size of the fragment of the cRNA naturally occurring in Bacteria and Archaea that is present in a crNucleotide disclosed herein can range from, but is not limited to, 2, 3, 4, 5, 6, 7, 8, 9, 10, 11, 12, 13, 14, 15, 16, 17, 18, 19, 20 or more nucleotides.

In an aspect, the second molecule of the duplex guide polynucleotide comprising a CER domain is referred to as "tracrRNA" (when composed of a contiguous stretch of RNA nucleotides) or "tracrDNA" (when composed of a contiguous stretch of DNA nucleotides) or "tracrDNA-RNA" (when composed of a combination of DNA and RNA nucleotides. In an aspect, the RNA that guides the RNA Cas9 endonuclease complex, is a duplexed RNA comprising a duplex crRNA-tracrRNA.

The guide polynucleotide can also be a single molecule comprising a first nucleotide sequence domain (referred to as Variable Targeting domain or VT domain) that is complementary to a nucleotide sequence in a target DNA and a second nucleotide domain (referred to as Cas endonuclease recognition domain or CER domain) that interacts with a Cas endonuclease polypeptide. By "domain" it is meant a contiguous stretch of nucleotides that can be RNA, DNA, and/or RNA-DNA-combination sequence. The VT domain and/or the CER domain of a single guide polynucleotide can comprise a RNA sequence, a DNA sequence, or a RNA-DNA-combination sequence. In an aspect, the single guide polynucleotide comprises a crNucleotide (comprising a VT domain linked to a CER domain) linked to a tracrNucleotide (comprising a CER domain), wherein the linkage is a nucleotide sequence comprising a RNA sequence, a DNA sequence, or a RNA-DNA combination sequence. The single guide polynucleotide being comprised of sequences from the crNucleotide and tracrNucleotide may be referred to as "single guide nucleotide" (when composed of a contiguous stretch of RNA nucleotides) or "single guide DNA" (when composed of a contiguous stretch of DNA nucleotides) or "single guide nucleotide-DNA" (when composed of a combination of RNA and DNA nucleotides). In an aspect of the disclosure, the single guide nucleotide comprises a cRNA or cRNA fragment and a tracrRNA or tracrRNA fragment of the type II CRISPR/Cas system that can form a complex with a type II Cas endonuclease, wherein the guide nucleotide Cas endonuclease complex can direct the Cas endonuclease to a plant genomic target site, enabling the Cas endonuclease to introduce a double strand break into the genomic target site. One aspect of using a single guide polynucleotide versus a duplex guide polynucleotide is that only one expression cassette needs to be made to express the single guide polynucleotide.

The term "variable targeting domain" or "VT domain" is used interchangeably herein and includes a nucleotide sequence that is complementary to one strand (nucleotide sequence) of a double strand DNA target site. The % complementation between the first nucleotide sequence domain (VT domain) and the target sequence can be at least 50%, 51%, 52%, 53%, 54%, 55%, 56%, 57%, 58%, 59%, 60%, 61%, 62%, 63%, 63%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. The variable target domain can be at least 12, 13, 14, 15, 16, 17, 18, 19, 20, 21, 22, 23, 24, 25, 26, 27, 28, 29 or 30 nucleotides in length. In an aspect, the variable targeting domain comprises a contiguous stretch of 12 to 30 nucleotides. The variable targeting domain can be composed of a DNA sequence, a RNA sequence, a modified DNA sequence, a modified RNA sequence, or any combination thereof.

The term "Cas endonuclease recognition domain" or "CER domain" of a guide polynucleotide is used interchangeably herein and includes a nucleotide sequence (such as a second nucleotide sequence domain of a guide polynucleotide), that interacts with a Cas endonuclease polypeptide. The CER domain can be composed of a DNA sequence, a RNA sequence, a modified DNA sequence, a modified RNA sequence (see for example modifications described herein), or any combination thereof.

The nucleotide sequence linking the crNucleotide and the tracrNucleotide of a single guide polynucleotide can comprise a RNA sequence, a DNA sequence, or a RNA-DNA combination sequence. In an aspect, the nucleotide sequence linking the crNucleotide and the tracrNucleotide of a single guide polynucleotide can be at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 78, 79, 80, 81, 82, 83, 84, 85, 86, 87, 88, 89, 90, 91, 92, 93, 94, 95, 96, 97, 98, 99 or 100 nucleotides in length. In another aspect, the nucleotide sequence linking the crNucleotide and the tracrNucleotide of a single guide polynucleotide can comprise a tetraloop sequence, such as, but not limiting to a GAAA tetraloop sequence.

Nucleotide sequence modification of the guide polynucleotide, VT domain and/or CER domain can be selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications can result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

In an aspect, the guide nucleotide and Cas endonuclease are capable of forming a complex that enables the Cas endonuclease to introduce a double strand break at a DNA target site.

In an aspect of the disclosure the variable target domain is 12, 13, 14, 15, 16, 17, 18, 19, 20, 21, 22, 23, 24, 25, 26, 27, 28, 29 or 30 nucleotides in length.

In an aspect of the disclosure, the guide nucleotide comprises a cRNA (or cRNA fragment) and a tracrRNA (or tracrRNA fragment) of the type II CRISPR/Cas system that can form a complex with a type II Cas endonuclease, wherein the guide nucleotide Cas endonuclease complex can direct the Cas endonuclease to a plant genomic target site, enabling the Cas endonuclease to introduce a double strand break into the genomic target site. The guide nucleotide can be introduced into a plant or plant cell directly using any method known in the art such as, but not limited to, particle bombardment or topical applications.

In an aspect, the guide nucleotide can be introduced indirectly by introducing a recombinant DNA molecule comprising the corresponding guide DNA sequence operably linked to a plant specific promoter that is capable of transcribing the guide nucleotide in the plant cell. The term "corresponding guide DNA" includes a DNA molecule that is identical to the RNA molecule but has a "T" substituted for each "U" of the RNA molecule.

In an aspect, the guide nucleotide is introduced via particle bombardment or using the disclosed methods for *Agrobacterium* transformation of a recombinant DNA construct comprising the corresponding guide DNA operably linked to a plant U6 polymerase III promoter.

In an aspect, the RNA that guides the RNA Cas9 endonuclease complex, is a duplexed RNA comprising a duplex crRNA-tracrRNA. One advantage of using a guide nucleotide versus a duplexed crRNA-tracrRNA is that only one expression cassette needs to be made to express the fused guide nucleotide.

The terms "target site," "target sequence," "target DNA," "target locus," "genomic target site," "genomic target sequence," and "genomic target locus" are used interchangeably herein and refer to a polynucleotide sequence in the genome (including choloroplastic and mitochondrial DNA) of a plant cell at which a double-strand break is induced in the plant cell genome by a Cas endonuclease. The target site can be an endogenous site in the plant genome, or alternatively, the target site can be heterologous to the plant and thereby not be naturally occurring in the genome, or the target site can be found in a heterologous genomic location compared to where it occurs in nature.

As used herein, terms "endogenous target sequence" and "native target sequence" are used interchangeably herein to refer to a target sequence that is endogenous or native to the genome of a plant and is at the endogenous or native position of that target sequence in the genome of the plant. In an aspect, the target site can be similar to a DNA recognition site or target site that that is specifically recognized and/or bound by a double-strand break inducing agent such as a LIG3-4 endonuclease (US Patent Application Publication Number 2009/0133152) or a MS26++ meganuclease (US Patent Application Publication Number 2014/0020131).

An "artificial target site" or "artificial target sequence" are used interchangeably herein and refer to a target sequence that has been introduced into the genome of a plant. Such an artificial target sequence can be identical in sequence to an endogenous or native target sequence in the genome of a plant but be located in a different position (i.e., a non-endogenous or non-native position) in the genome of a plant.

An "altered target site," "altered target sequence" "modified target site," and "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

In an aspect, the disclosed methods can be used to introduce into plants polynucleotides useful for gene suppression of a target gene in a plant. Reduction of the activity of specific genes (also known as gene silencing, or gene suppression) is desirable for several aspects of genetic engineering in plants. Many techniques for gene silencing are well known to one of skill in the art, including but not limited to antisense technology (see, e.g., Sheehy et al. (1988) Proc. Natl. Acad. Sci. USA 85:8805-8809; and U.S. Pat. Nos. 5,107,065; 5,453,566; and 5,759,829); cosuppression (e.g., Taylor (1997) Plant Cell 9:1245; Jorgensen (1990) Trends Biotech. 8(12):340-344; Flavell (1994) Proc. Natl. Acad. Sci. USA 91:3490-3496; Finnegan et al. (1994) Bio/Technology 12: 883-888; and Neuhuber et al. (1994) Mol. Gen. Genet. 244:230-241); RNA interference (Napoli et al. (1990) Plant Cell 2:279-289; U.S. Pat. No. 5,034,323; Sharp (1999) Genes Dev. 13:139-141; Zamore et al. (2000) Cell 101:25-33; Javier (2003) Nature 425:257-263; and, Montgomery et al. (1998) Proc. Natl. Acad. Sci. USA 95:15502-15507), virus-induced gene silencing (Burton, et al. (2000) Plant Cell 12:691-705; and Baulcombe (1999) Curr. Op. Plant Bio. 2:109-113); target-RNA-specific ribozymes (Haseloff et al. (1988) Nature 334: 585-591); hairpin structures (Smith et al. (2000) Nature 407:319-320; WO 99/53050; WO 02/00904; and WO 98/53083); ribozymes (Steinecke et al. (1992) EMBO J. 11:1525; U.S. Pat. No. 4,987,071; and, Perriman et al. (1993) Antisense Res. Dev. 3:253); oligonucleotide mediated targeted modification (e.g., WO 03/076574 and WO 99/25853); Zn-finger targeted molecules (e.g., WO 01/52620; WO 03/048345; and WO 00/42219); artificial micro RNAs (U.S. Pat. No. 8,106,180; Schwab et al. (2006) Plant Cell 18:1121-1133); and other methods or combinations of the above methods known to those of skill in the art.

In an aspect, the disclosed methods can be used to introduce into plants polynucleotides useful for the targeted integration of nucleotide sequences into a plant. For example, the disclosed methods can be used to introduce T-DNA expression cassettes comprising nucleotide sequences of interest flanked by non-identical recombination sites are used to transform a plant comprising a target site. In an aspect, the target site contains at least a set of non-identical recombination sites corresponding to those on the T-DNA expression cassette. The exchange of the nucleotide sequences flanked by the recombination sites is affected by a recombinase. Thus, the disclosed methods can be used for the introduction of T-DNA expression cassettes for targeted integration of nucleotide sequences, wherein the T-DNA expression cassettes which are flanked by non-identical recombination sites recognized by a recombinase that recognizes and implements recombination at the non-identical recombination sites. Accordingly, the disclosed methods and composition can be used to improve efficiency and speed of development of plants containing non-identical recombination sites.

Thus, the disclosed methods can further comprise methods for the directional, targeted integration of exogenous nucleotides into a transformed plant. In an aspect, the disclosed methods use novel recombination sites in a gene targeting system which facilitates directional targeting of desired genes and nucleotide sequences into corresponding recombination sites previously introduced into the target plant genome.

In an aspect, a nucleotide sequence flanked by two non-identical recombination sites is introduced into one or more cells of an explant derived from the target organism's genome establishing a target site for insertion of nucleotide sequences of interest. Once a stable plant or cultured tissue is established a second construct, or nucleotide sequence of interest, flanked by corresponding recombination sites as those flanking the target site, is introduced into the stably transformed plant or tissues in the presence of a recombinase protein. This process results in exchange of the nucleotide sequences between the non-identical recombination sites of the target site and the T-DNA expression cassette.

It is recognized that the transformed plant prepared in this manner may comprise multiple target sites; i. e., sets of non-identical recombination sites. In this manner, multiple manipulations of the target site in the transformed plant are available. By target site in the transformed plant is intended a DNA sequence that has been inserted into the transformed plant's genome and comprises non-identical recombination sites.

Examples of recombination sites for use in the disclosed method are known in the art and include FRT sites (See, for example, Schlake and Bode (1994) Biochemistry 33: 12746-12751; Huang et al. (1991) Nucleic Acids Research 19: 443-448; Paul D. Sadowski (1995) In Progress in Nucleic Acid Research and Molecular Biology vol. 51, pp. 53-91; Michael M. Cox (1989) In Mobile DNA, Berg and Howe (eds) American Society of Microbiology, Washington D. C., pp. 116-670; Dixon et al. (1995) 18: 449-458; Umlauf and Cox (1988) The EMBO Journal 7: 1845-1852; Buchholz et al. (1996) Nucleic Acids Research 24: 3118-3119; Kilby et al. (1993) Trends Genet. 9: 413-421: Rossant and Geagy (1995) Nat. Med. 1: 592-594; Albert et al. (1995) The Plant J. 7: 649-659: Bayley et al. (1992) Plant Mol. Biol. 18: 353-361; Odell et al. (1990) Mol. Gen. Genet. 223: 369-378; and Dale and Ow (1991) Proc. Natl. Acad. Sci. USA 88: 10558-105620; all of which are herein incorporated by reference.); Lox (Albert et al. (1995) Plant J. 7: 649-659; Qui et al. (1994) Proc. Natl. Acad. Sci. USA 91: 1706-1710; Stuurman et al. (1996) Plant Mol. Biol. 32: 901-913; Odell et al. (1990) Mol. Gen. Gevet. 223: 369-378; Dale et al. (1990) Gene 91: 79-85; and Bayley et al. (1992) Plant Mol. Biol. 18: 353-361.) The two-micron plasmid found in most naturally occurring strains of *Saccharomyces cerevisiae*, encodes a site-specific recombinase that promotes an inversion of the DNA between two inverted repeats. This inversion plays a central role in plasmid copy-number amplification.

The protein, designated FLP protein, catalyzes site-specific recombination events. The minimal recombination site (FRT) has been defined and contains two inverted 13-base pair (bp) repeats surrounding an asymmetric 8-bp spacer. The FLP protein cleaves the site at the junctions of the repeats and the spacer and is covalently linked to the DNA via a 3'phosphate. Site specific recombinases like FLP cleave and religate DNA at specific target sequences, resulting in a precisely defined recombination between two identical sites. To function, the system needs the recombination sites and the recombinase. No auxiliary factors are needed. Thus, the entire system can be inserted into and function in plant cells. The yeast FLP\FRT site specific recombination system has been shown to function in plants. To date, the system has been utilized for excision of unwanted DNA. See, Lyznik et at. (1993) Nucleic Acid Res. 21: 969-975. In contrast, the present disclosure utilizes non-identical FRTs for the exchange, targeting, arrangement, insertion and control of expression of nucleotide sequences in the plant genome.

In an aspect, a transformed organism of interest, such as an explant from a plant, containing a target site integrated into its genome is needed. The target site is characterized by being flanked by non-identical recombination sites. A targeting cassette is additionally required containing a nucleotide sequence flanked by corresponding non-identical recombination sites as those sites contained in the target site of the transformed organism. A recombinase which recognizes the non-identical recombination sites and catalyzes site-specific recombination is required.

It is recognized that the recombinase can be provided by any means known in the art. That is, it can be provided in the organism or plant cell by transforming the organism with an expression cassette capable of expressing the recombinase in the organism, by transient expression, or by providing messenger RNA (mRNA) for the recombinase or the recombinase protein.

By "non-identical recombination sites" it is intended that the flanking recombination sites are not identical in sequence and will not recombine or recombination between the sites will be minimal. That is, one flanking recombination site may be a FRT site where the second recombination site may be a mutated FRT site. The non-identical recombination sites used in the methods of the disclosure prevent or greatly suppress recombination between the two flanking recombination sites and excision of the nucleotide sequence contained therein. Accordingly, it is recognized that any suitable non-identical recombination sites may be utilized in the disclosure, including FRT and mutant FRT sites, FRT and lox sites, lox and mutant lox sites, as well as other recombination sites known in the art.

By suitable non-identical recombination site implies that in the presence of active recombinase, excision of sequences between two non-identical recombination sites occurs, if at all, with an efficiency considerably lower than the recombinationally-mediated exchange targeting arrangement of nucleotide sequences into the plant genome. Thus, suitable non-identical sites for use in the disclosure include those sites where the efficiency of recombination between the sites is low; for example, where the efficiency is less than about 30 to about 50%, preferably less than about 10 to about 30%, more preferably less than about 5 to about 10%.

As noted above, the recombination sites in the targeting cassette correspond to those in the target site of the transformed plant. That is, if the target site of the transformed plant contains flanking non-identical recombination sites of FRT and a mutant FRT, the targeting cassette will contain the same FRT and mutant FRT non-identical recombination sites.

It is furthermore recognized that the recombinase, which is used in the disclosed methods, will depend upon the recombination sites in the target site of the transformed plant and the targeting cassette. That is, if FRT sites are utilized, the FLP recombinase will be needed. In the same manner, where lox sites are utilized, the Cre recombinase is required. If the non-identical recombination sites comprise both a FRT and a lox site, both the FLP and Cre recombinase will be required in the plant cell.

The FLP recombinase is a protein which catalyzes a site-specific reaction that is involved in amplifying the copy number of the two micron plasmid of *S. cerevisiae* during DNA replication. FLP protein has been cloned and expressed. See, for example, Cox (1993) Proc. Natl. Acad. Sci. U.S.A 80: 4223-4227. The FLP recombinase for use in the disclosure may be that derived from the genus *Saccharomyces*. It may be preferable to synthesize the recombinase using plant preferred codons for optimum expression in a plant of interest. See, for example, U.S. application Ser. No. 08/972,258 filed Nov. 18, 1997, entitled "Novel Nucleic Acid Sequence Encoding FLP Recombinase," herein incorporated by reference.

The bacteriophage recombinase Cre catalyzes site-specific recombination between two lox sites. The Cre recombinase is known in the art. See, for example, Guo et al. (1997) Nature 389: 40-46; Abremski et al. (1984) J. Biol. Chem. 259: 1509-1514; Chen et al. (1996) Somat. Cell Mol. Genet. 22: 477-488; and Shaikh et al. (1977) J. Biol. Chem. 272: 5695-5702. All of which are herein incorporated by reference. Such Cre sequence may also be synthesized using plant preferred codons.

Where appropriate, the nucleotide sequences to be inserted in the plant genome may be optimized for increased expression in the transformed plant. Where mammalian, yeast, or bacterial genes are used in the disclosure, they can be synthesized using plant preferred codons for improved expression. It is recognized that for expression in monocots, dicot genes can also be synthesized using monocot preferred codons. Methods are available in the art for synthesizing plant preferred genes. See, for example, U.S. Pat. Nos. 5,380,831, 5,436,391, and Murray et al. (1989) Nucleic Acids Res. 17: 477-498, herein incorporated by reference. The plant preferred codons may be determined from the codons utilized more frequently in the proteins expressed in the plant of interest. It is recognized that monocot or dicot preferred sequences may be constructed as well as plant preferred sequences for particular plant species. See, for example, EPA 0359472; EPA 0385962; WO 91/16432; Perlak et al. (1991) Proc. Natl. Acad. Sci. USA, 88: 3324-3328; and Murray et al. (1989) Nucleic Acids Research, 17: 477-498. U.S. Pat. Nos. 5,380,831; 5,436,391; and the like, herein incorporated by reference. It is further recognized that all or any part of the gene sequence may be optimized or synthetic. That is, fully optimized or partially optimized sequences may also be used.

Additional sequence modifications are known to enhance gene expression in a cellular host and can be used in the disclosure. These include elimination of sequences encoding spurious polyadenylation signals, exon-intron splice site signals, transposon-like repeats, and other such well-characterized sequences, which may be deleterious to gene expression. The G-C content of the sequence may be adjusted to levels average for a given cellular host, as calculated by reference to known genes expressed in the host cell. When possible, the sequence is modified to avoid predicted hairpin secondary RNA structures.

The present disclosure also encompasses novel FLP recombination target sites (FRT). The FRT has been identified as a minimal sequence comprising two 13 base pair repeats, separated by an eight 8 base spacer, as follows: 5'-GAAGTTCCTATTC [TCTAGAAA] GTATAGGAACTTC3' wherein the nucleotides within the brackets indicate the spacer region. The nucleotides in the spacer region can be replaced with a combination of nucleotides, so long as the two 13-base repeats are separated by eight nucleotides. It appears that the actual nucleotide sequence of the spacer is not critical; however, for the practice of the disclosure, some substitutions of nucleotides in the space region may work better than others. The eight base pair spacer is involved in DNA-DNA pairing during strand exchange. The asymmetry of the region determines the direction of site alignment in the recombination event, which will subsequently lead to either inversion or excision. As indicated above, most of the spacer can be mutated without a loss of function. See, for example, Schlake and Bode (1994) Biochemistry 33: 12746-12751, herein incorporated by reference.

Novel FRT mutant sites can be used in the practice of the disclosed methods. Such mutant sites may be constructed by PCR-based mutagenesis. Although mutant FRT sites are known (see SEQ ID Nos 2, 3, 4 and 5 of WO1999/025821), it is recognized that other mutant FRT sites may be used in the practice of the disclosure. The present disclosure is not the use of a particular FRT or recombination site, but rather that non-identical recombination sites or FRT sites can be utilized for targeted insertion and expression of nucleotide sequences in a plant genome. Thus, other mutant FRT sites can be constructed and utilized based upon the present disclosure.

As discussed above, bringing genomic DNA containing a target site with non-identical recombination sites together with a vector containing a T-DNA expression cassette with corresponding non-identical recombination sites, in the presence of the recombinase, results in recombination. The nucleotide sequence of the T-DNA expression cassette located between the flanking recombination sites is exchanged with the nucleotide sequence of the target site located between the flanking recombination sites. In this manner, nucleotide sequences of interest may be precisely incorporated into the genome of the host.

It is recognized that many variations of the disclosure can be practiced. For example, target sites can be constructed having multiple non-identical recombination sites. Thus, multiple genes or nucleotide sequences can be stacked or ordered at precise locations in the plant genome. Likewise, once a target site has been established within the genome, additional recombination sites may be introduced by incorporating such sites within the nucleotide sequence of the T-DNA expression cassette and the transfer of the sites to the target sequence. Thus, once a target site has been established, it is possible to subsequently add sites, or alter sites through recombination.

Another variation includes providing a promoter or transcription initiation region operably linked with the target site in an organism. Preferably, the promoter will be 5' to the first recombination site. By transforming the organism with a T-DNA expression cassette comprising a coding region, expression of the coding region will occur upon integration of the T-DNA expression cassette into the target site. This aspect provides for a method to select transformed cells, particularly plant cells, by providing a selectable marker sequence as the coding sequence.

Other advantages of the present system include the ability to reduce the complexity of integration of transgenes or transferred DNA in an organism by utilizing T-DNA expression cassettes as discussed above and selecting organisms with simple integration patterns. In the same manner, preferred sites within the genome can be identified by comparing several transformation events. A preferred site within the genome includes one that does not disrupt expression of essential sequences and provides for adequate expression of the transgene sequence.

The disclosed methods also provide for means to combine multiple expression cassettes at one location within the genome. Recombination sites may be added or deleted at target sites within the genome.

Any means known in the art for bringing the three components of the system together may be used in the disclosure. For example, a plant can be stably transformed to harbor the target site in its genome. The recombinase may be transiently expressed or provided. Alternatively, a nucleotide sequence capable of expressing the recombinase may be stably integrated into the genome of the plant. In the presence of the corresponding target site and the recombinase, the T-DNA expression cassette, flanked by corresponding non-identical recombination sites, is inserted into the transformed plant's genome.

Alternatively, the components of the system may be brought together by sexually crossing transformed plants. In this aspect, a transformed plant, parent one, containing a target site integrated in its genome can be sexually crossed with a second plant, parent two, that has been genetically transformed with a T-DNA expression cassette containing flanking non-identical recombination sites, which correspond to those in plant one. Either plant one or plant two contains within its genome a nucleotide sequence expressing recombinase. The recombinase may be under the control of a constitutive or inducible promoter. In this manner, expression of recombinase and subsequent activity at the recombination sites can be controlled.

The disclosed methods are useful in targeting the integration of transferred nucleotide sequences to a specific chromosomal site. The nucleotide sequence may encode any nucleotide sequence of interest. Particular genes of interest include those which provide a readily analyzable functional feature to the host cell and/or organism, such as marker genes, as well as other genes that alter the phenotype of the recipient cells, and the like. Thus, genes effecting plant growth, height, susceptibility to disease, insects, nutritional value, and the like may be utilized in the disclosure. The nucleotide sequence also may encode an 'antisense' sequence to turn off or modify gene expression.

It is recognized that the nucleotide sequences will be utilized in a functional expression unit or T-DNA expression cassette. By functional expression unit or T-DNA expression cassette is intended, the nucleotide sequence of interest with a functional promoter, and in most instances a termination region. There are various ways to achieve the functional expression unit within the practice of the disclosure. In one aspect of the disclosure, the nucleic acid of interest is transferred or inserted into the genome as a functional expression unit.

Alternatively, the nucleotide sequence may be inserted into a site within the genome which is 3' to a promoter region. In this latter instance, the insertion of the coding sequence 3' to the promoter region is such that a functional expression unit is achieved upon integration. The T-DNA expression cassette will comprise a transcriptional initiation region, or promoter, operably linked to the nucleic acid encoding the peptide of interest. Such an expression cassette is provided with a plurality of restriction sites for insertion of the gene or genes of interest to be under the transcriptional regulation of the regulatory regions.

EXPERIMENTAL

Example 1: Plasmids

See Table 7 for a description of the plasmids comprising the indicated components referenced in the Examples. Plasmid IDs followed by a "+" comprise T-DNA containing the indicated components and additional indicated components located beyond the T-DNA Left Border (LB). As is within the skill in the art, the additional components may alternatively be located beyond the T-DNA Right Border (RB).

TABLE 7

| SEQ ID NO: | Plasmid ID | Plasmid Components |
|---|---|---|
| 105 | PHP87078 | RB + FMV ENH:PSCV ENH:MMV ENH:ZM-PLTP PRO::ZM-WUS2::IN2-1 TERM + SB-UBI PRO::ZS-GREEN1::OS-UBI TERM + LB |
| 106 | PHP87598 | RB + LOXP + FMV ENH:PSCV ENH:MMV ENH:ZM-PLTP PRO::ZM-WUS2::IN2-1 TERM + ZM-H5P26 PRO::MO CRE EXON1:ST-LS1 INTRON:MO-CRE EXON2::PINII TERM + NOS PRO::CRC::SB-GKAF TERM + LOXP + LB |
| 107 | PHP88156 | RB + FMV ENH:PSCV ENH:MMV ENH:ZM-PLTP PRO:3xEME::ZM-WUS2::IN2-1 TERM + NOS PRO::CRC::SB-GKAF TERM + LB |
| 108 | PHP88157 | RB + FMV ENH:PSCV ENH:MMV ENH:ZM-PLTP PRO:1xEME::ZM-WUS2::IN2-1 TERM + NOS PRO::CRC::SB-GKAF TERM + LB |
| 109 | PHP88158 | RB + FMV ENH:PSCV ENH:MMV ENH:ZM-PLTP PRO::ZM-WUS2::IN2-1 TERM + NOS PRO::CRC::SB-GKAF TERM + LB |

TABLE 7-continued

| SEQ ID NO: | Plasmid ID | Plasmid Components |
|---|---|---|
| 110 | PHP86491 | RB + SB-UBI PRO::ZS-GREEN1::OS-UBI TERM + SB-ALS PRO::ZM-HRA::PINII TERM + LB |
| 111 | PHP81561 | RB + ZM-UBII PRO::ZS-YELLOW::PINII TERM + ZM-UBII PRO::NPTII::PINII TERM + LB |
| 112 | PHP86295+ | RB + LOXP + SI-UBI3 PRO::ZS-GREEN1::PINII TERM + SB-ALS PRO::ZM-HRA::SB-PEPC1 TERM + LB + ZM-PLTP PRO::ZM-WUS2::IN2-1 TERM + ZM-PLTP PRO::ZM-ODP2::OS-T28 TERM |
| 113 | PHP86296+ | RB + LOXP + SI-UBI3 PRO::ZS-GREEN1::PINII TERM + SB-ALS PRO::ZM-HRA::SB-PEPC1 TERM + LB + ZM-PLTP PRO::ZM-WUS2::IN2-1 TERM |
| 114 | PHP86297+ | RB + LOXP + SI-UBI3 PRO::ZS-GREEN1::PINII TERM + SB-ALS PRO::ZM-HRA::SB-PEPC1 TERM + LB + ZM-PLTP PRO::ZM-WUS2~T2A~ZM-ODP2::OS-T28 TERM |
| 115 | PHP88194 | RB + AT-UBQ10 PRO::CTP::SPCN::UBQ14 TERM + GM-UBQ PRO::ZS-YELLOW N1::NOS TERM + LB |
| 116 | PHP90094 | RB + CAMV35S PRO::HA-WUS::OS-T28 TERM + FMV ENHANCER:PCSV ENHANCER:MMV ENHANCER + LB |
| 117 | PHP88193 | RB + AT-UBQ10 PRO::CTP::SPCN::UBQ14 TERM + GM-UBQ PRO::ZS-YELLOW1 N1::NOS TERM + LB |
| 118 | PHP0001+ | RB + AT-UBQ10 PRO::CTP::SPCN::UBQ14 TERM + GM-UBQ PRO::ZS-YELLOW N1::NOS TERM + LB + FMV ENH:PSCV ENH:MMV ENH:CAMV35S PRO::HA-WUS::0S-T28 TERM |
| 119 | PHP80728 | RB + GM-UBQ PRO::TAG-RFP::AT-UBQ3 TERM + GM-SAMS PRO::GM-HRA::GM-ALS TERM + LB |
| 120 | PHP81718+ | RB + GM-UBQ PRO::TAG-RFP::AT-UBQ3 TERM + GM-SAMS PRO::GM-HRA::GM-ALS TERM + LB + GM-EF1A PRO::AT-WUS::UBQ14 TERM |
| 121 | PHP0002+ | RB + LOXP + SI-UBI3 PRO::ZS-GREEN1::PINII TERM + SB-ALS PRO::ZM-HRA::SB-PEPC1 TERM + LB + ZM-PLTP PRO::ZM-WUS2::IN2-1 TERM + ZM-PLTP PRO::WDV-RepA::OS-T28 TERM |
| 122 | PHP0003+ | RB + LOXP + SI-UBI3 PRO::ZS-GREEN1::PINII TERM + SB-ALS PRO::ZM-HRA::SB-PEPC1 TERM + LB + ZM-PLTP PRO::ZM-WUS2::IN2-1 TERM + ZM-PLTP PRO::PKLamiRNA::OS-T28 TERM |
| 123 | PHP5096 | UBI1ZM PRO::FLPm::PINII TERM |
| 124 | PHP89030 | ZM-PLTP PRO::ZM-ODP2::OS-T28 TERM + FMV & PCSV ENHANCERS |
| 125 | PHP89179 | ZM-PLTP PRO::ZM-WUS2::IN2-1 TERM |
| 126 | PHP0004 | FRT1:PMI::PINII TERM + UBI1ZM PRO::DS-RED2::PINII TERM + FRT87 |
| 127 | PHP0005+ | RB + SI-UBI PRO::ZS-GREEN::PINII TERM + SB-ALS PRO::ZM-HRA::SB-PEPC1 TERM + LB + ZM-PLTP PRO::WUS2~T2A~WDV-RepA::IN2-1 TERM |
| 128 | PHP38042+ | RB + CAMV35S PRO:3xTET-OP:ADH1 INTRON1::MO-PAT~DS-RED EXPRESS::PINII TERM + LB + UBI1ZM PRO::TET REPRESSOR::PINII TERM |
| 129 | PHP89484+ | RB + AT-UBQ10 PRO::CTP::SPCN::UBQ14 TERM + GM-UBQ PRO::DS-RED2::UBQ3 TERM + LB + CAMV35S PRO::HA-WUS::OS-T28 TERM + FMC ENH::PCSV ENH::MMV ENH |
| 130 | PHP93161 | RB + LOXP + FMV ENHANCER:PCSV ENHANCER:MMV ENHANCER::LTP2 PRO::ZM-WUS2::IN2-1 TERM + NOS PRO::CRC::SB-GKAF TERM + LB |
| 131 | PHP92349 | RB + LOXP + GM-QBU PRO::CTP:SPCN::UBQ14 TERM + GM-EF1A2 PRO::DS-RED2::UBQ3 TERM + LOXP + LB |
| 132 | PHP71539 | pVIR9 |
| 133 | dCAS9~EAR | UBI1ZM PRO::UBI1ZM INTRON1::NLS:dCAS9:VIRD2 NLS:PROTEIN LINKER:ZM-ERF3 REPRESSOR PEPTIDE::OS-T28 TERM |

Example 2: Culture Media

See Tables 8, 9, and 10 for a description of the media formations for transformation, selection and regeneration referenced in the Examples.

TABLE 8

| Medium components | Units per liter | 12R | 810K | 700A | 710I | 605J | 605T | 562V | 289Q |
|---|---|---|---|---|---|---|---|---|---|
| MS BASAL SALT MIXTURE | g | | | 4.3 | 4.3 | 4.3 | 4.3 | | 4.3 |
| N6 BASAL SALTS | g | | | | | | | 4.0 | |
| N6 MACRONUTRIENTS 10X | ml | | | | | 60.0 | 60.0 | | |
| POTASSIUM NITRATE | g | | | | | 1.7 | 1.7 | | |
| B5H MINOR SALTS 1000X | ml | | | | | 0.6 | 0.6 | | |
| NaFe EDTA FOR B5H 100X | ml | | | | | 6.0 | 6.0 | | |
| ERIKSSON'S VITAMINS 1000X | ml | | | | | 0.4 | 0.4 | 1.0 | |
| S&H VITAMIN STOCK 100X | ml | | | | | 6.0 | 6.0 | | |
| THIAMINE•HCL | mg | | | 10.0 | 10.0 | 0.5 | 0.5 | 0.5 | |
| L-PROLINE | g | | | | 0.7 | 2.0 | 2.0 | 0.69 | 0.7 |
| CASEIN HYDROLYSATE (ACID) | g | | | | | 0.3 | 0.3 | | |
| SUCROSE | g | | | 68.5 | 20.0 | 20.0 | 20.0 | 30.0 | 60.0 |
| GLUCOSE | g | 5.0 | | 36.0 | 10.0 | 0.6 | 0.6 | | |
| MALTOSE | g | | | | | | | | |
| 2,4-D | mg | | | 1.5 | 2.0 | 0.8 | 0.8 | 2.0 | |
| AGAR | g | 15.0 | | | 8.0 | 6.0 | 6.0 | 8.0 | 8.0 |
| BACTO-AGAR | g | | 15.0 | | | | | | |
| PHYTAGEL | g | | | | | | | | |
| DICAMBA | g | | | | | 1.2 | 1.2 | | |
| SILVER NITRATE | mg | | | | | 3.4 | 3.4 | 0.85 | |
| AGRIBIO Carbenicillin | mg | | | | | 100.0 | | | |
| Timentin | mg | | | | | | 150.0 | | 150.0 |
| Cefotaxime | mg | | | | | | 100.0 | | 100.0 |
| MYO-INOSITOL | g | | | 0.1 | 0.1 | | | | 0.1 |
| NICOTINIC ACID | mg | | | 0.5 | 0.5 | | | | |
| PYRIDOXINE•HCL | mg | | | 0.5 | 0.5 | | | | |
| VITAMIN ASSAY CASAMINO ACIDS | g | | | 1.0 | | | | | |
| MES BUFFER | g | | | | 0.5 | | | | |
| ACETOSYRINGONE | uM | | | | 100.0 | | | 100.0 | |
| ASCORBIC ACID 10 MG/ML (7S) | mg | | | | 10.0 | | | | |
| MS VITAMIN STOCK SOL. | ml | | | | | | | | 5.0 |
| ZEATIN | mg | | | | | | | | 0.5 |
| CUPRIC SULFATE | mg | | | | | | | | 1.3 |
| IAA 0.5 MG/ML (28A) | ml | | | | | | | | 2.0 |
| ABA 0.1 mm | ml | | | | | | | | 1.0 |
| THIDIAZURON | mg | | | | | | | | 0.1 |
| AGRIBIO Carbenicillin | mg | | | | | | | | 100.0 |
| PPT(GLUFOSINATE-NH4) | mg | | | | | | | | |
| BAP | mg | | | | | | | | 1.0 |
| YEAST EXTRACT (BD Difco) | g | | 5.0 | | | | | | |
| PEPTONE | g | | 10.0 | | | | | | |
| SODIUM CHLORIDE | g | | 5.0 | | | | | | |
| SPECTINOMYCIN | mg | 50.0 | 50.0 | | | | | | |
| FERROUS SULFATE•7H20 | ml | 2.0 | | | | | | | |
| AB BUFFER 20X (12D) | ml | 50.0 | | | | | | | |
| AB SALTS 20X (12E) | ml | 50.0 | | | | | | | |
| THYMIDINE | mg | 50.0 | 50.0 | 50.0 | | | | 50.0 | |
| GENTAMYCIN | mg | 50.0 | 50.0 | | | | | | |
| Benomyl | mg | | | | | | | | |
| pH | | | 6.8 | 5.2 | 5.8 | 5.8 | 5.8 | 5.8 | 5.6 |

TABLE 9

| Medium components | Units per liter | 20A | 70A | 70B | 70C |
|---|---|---|---|---|---|
| MS BASAL SALT MIXTURE | g | 4.3 | 4.3 | 4.3 | 4.3 |
| THIAMINE•HCL | mg | 0.12 | 0.12 | 0.12 | 0.12 |
| SUCROSE | g | | 20 | 20 | 20 |
| PVP40 | g | | 0.5 | 0.5 | 0.5 |
| TC AGAR | g | | 5 | 5 | 5 |
| SILVER NITRATE | mg | | 2.0 | 2.0 | 2.0 |
| AGRIBIO Carbenicillin | g | | 0.5 | 0.5 | 0.5 |
| Adenine Hemisulfate Salt | mg | | 40 | 40 | 40 |
| MYO-INOSITOL | g | 0.1 | 0.1 | 0.1 | 0.1 |
| NICOTINIC ACID | mg | 0.57 | 0.57 | 0.57 | 0.57 |
| PYRIDOXINE•HCL | mg | 0.57 | 0.57 | 0.57 | 0.57 |
| Glycine | mg | 2.3 | 2.3 | 2.3 | 2.3 |
| MES BUFFER | g | 0.5 | 0.5 | 0.5 | 0.5 |
| ACETOSYRINGONE | uM | 200 | | | |
| NAA | mg | 0.1 | 0.1 | 0.1 | 0.1 |
| BAP | mg | 1.0 | 1.0 | 1.0 | 1.0 |
| Gibberellic Acid | ug | 10 | 10 | 10 | 10 |
| SPECTINOMYCIN | mg | | 5 | 10 | 10 |
| pH | | 5.5 | 5.7 | 5.7 | 5.7 |

The compositions of various media used in soybean transformation, tissue culture and regeneration are outlined in Table 10. In this table, medium M1 is used for initiation of suspension cultures, if this is the starting material for transformation. Media M2 and M3 represent typical co-cultivation media useful for *Agrobacterium* transformation of the entire range of explants listed above. Medium M4 is useful for selection (with the appropriate selective agent), M5 is used for somatic embryo maturation, and medium M6 is used for germination to produce T0 plantlets.

TABLE 10

| | M1 | M2 | M3 | M4 | M5 | M6 |
|---|---|---|---|---|---|---|
| MS salt with B5 vitamins (PhytoTech M404) | 4.44 g/L | | | 4.4 g/L | 4.44 g/L | |
| Gamborg B-5 basal medium (PhytoTech G398) | | | | | | 3.21 g/L |
| Modified MS salt (PhytoTech M571) | | 2.68 g/L | 2.68 g/L | | | |
| B5 vitamins (1000X) (PhytoTech G249) | | 1 ml | 1 ml | 1 ml | | |
| 2,4-D stock 10 mg/ml | 4 ml | 1 ml | 1 ml | 4 ml | | |
| $KNO_3$ | | 1.64 g/L | 1.64 g/L | | | |
| $(NH_4)_2SO_4$ | | 0.463 g/L | 0.463 g/L | | | |
| Asparagine | | 1 g/L | 1 g/L | | | |
| Sucrose | | 68.5 g/L | 85.6 g/L | | | 20 g/L |
| Glucose | 31.5 g/L | 36 g/L | 49.6 g/L | 31.5 g/l | | |
| Maltose | | | | | 60 g/L | |
| $MgCl_2 \cdot 6H_2O$ | | | | | 0.75 g/L | |
| Activated charcoal (PhytoTech C325) | | | | | 5 g/L | |
| Casein hydrolysate (PhytoTech C184) | | 1 g/L | 1 g/L | | | |
| pH | 7.0 | 5.4 | 5.4 | 7.0 | 5.7 | 5.7 |
| Acetosyringone | | 300 μM | 300 μM | | | |
| TC agar | 4 g/L | | | | | 5 g/L |
| Gelrite (Plant Media Cat# 714246) | | | | 2 g/l | 2 g/L | |

Example 3: Particle Bombardment

Pioneer inbred PH184C (disclosed in U.S. Pat. No. 8,445,763) that contains in chromosome-1 a pre-integrated Site-Specific Integration target site (Chrom-1 target site) composed of UBI PRO:FRT1:NPTII::PINII TERM+FRT87 is used. Prior to bombardment, 10-12 DAP (days after pollination) immature embryos are isolated from ears of Pioneer inbred PH184C and placed on 605J culture medium plus 16% sucrose for three hours to plasmolyze the scutellar cells.

Four plasmids are typically used for each particle bombardment:

1) a donor plasmid (100 ng/μ1) containing a FRT-flanked donor cassette for Recombinase-Mediated Cassette Exchange, for example a plasmid containing FRT1: PMI::PINII TERM+UBI1ZM PRO::DS-RED2::PINII TERM+FRT87 (PHP0004);
2) a plasmid (2.5 ng/μ1) containing the expression cassette UBI1ZM PRO::FLPm::PINII TERM (PHP5096);
3) a plasmid (10 ng/μ1) containing the expression cassette ZM-PLTP PRO::ZM-ODP2::OS-T28 TERM+FMV & PCSV ENHANCERS (PHP89030); and
4) a plasmid (5 ng/ul) containing the expression cassette ZM-PLTP PRO::ZM-WUS2::IN2-1 TERM (PHP89179).

To attach the DNA to 0.6 μm gold particles, the four plasmids are mixed by adding 10 μl of each plasmid together in a low-binding microfuge tube (Sorenson Bioscience 39640T) for a total of 40 μl. To this suspension, 50 μl of 0.6 μm gold particles (30 μg/μ1) and 1.0 μl of Transit 20/20 (Cat No MIR5404, Minis Bio LLC) are added, and the suspension is placed on a rotary shaker for 10 minutes. The suspension is centrifuged at 10,000 RPM (~9400×g) and the supernatant is discarded. The gold particles are re-suspended in 120 μl of 100% ethanol, briefly sonicated at low power and 10 μl is pipetted onto each carrier disc. The carrier discs are then air-dried to remove all remaining ethanol. Particle bombardment is performed using a Biolistics PDF-1000, at 28 inches of Mercury using a 200 PSI rupture disc. After particle bombardment, the immature embryos are selected on 605J medium modified to contain 12.5 g/l mannose and 5 g/l maltose and no sucrose. After 10-12 weeks on selection, plantlets are regenerated and analyzed using qPCR. It is expected that co-delivery of PLTP::ODP2 (PHP89030) and PLTP::WUS2 (PHP89179) along with the SSI components (Donor DNA (PHP0004)+UBI::FLP (PHP5096)) will produce high frequencies of site-specific integration of the donor fragment into the Chrom-1 target site (i.e. at rates of 4-7% relative to the number of bombarded immature embryos).

Example 4: *Agrobacterium*-Mediated Transformation of Corn

A. Preparation of *Agrobacterium* Master Plate.

*Agrobacterium tumefaciens* harboring a binary donor vector was streaked out from a −80° C. frozen aliquot onto solid 12R medium and cultured at 28° C. in the dark for 2-3 days to make a master plate.

B. Growing *Agrobacterium* on Solid Medium.

A single colony or multiple colonies of *Agrobacterium* were picked from the master plate and streaked onto a second plate containing 810K medium and incubated at 28° C. in the dark overnight.

*Agrobacterium* infection medium (700 A; 5 ml) and 100 mM 3'-5'-Dimethoxy-4'-hydroxyacetophenone (acetosyringone; 5 μL) were added to a 14 mL conical tube in a hood. About 3 full loops of *Agrobacterium* from the second plate were suspended in the tube and the tube was then vortexed to make an even suspension. The suspension (1 ml) was transferred to a spectrophotometer tube and the optical density (550 nm) of the suspension was adjusted to a reading of about 0.35-1.0. The *Agrobacterium* concentration was approximately 0.5 to $2.0\times10^9$ cfu/mL. The final *Agrobacterium* suspension was aliquoted into 2 mL microcentrifuge tubes, each containing about 1 mL of the suspension. The suspensions were then used as soon as possible.

C. Growing *Agrobacterium* on Liquid Medium.

Alternatively, *Agrobacterium* can be prepared for transformation by growing in liquid medium. One day before infection, a 125 ml flask was prepared with 30 ml of 557A medium (10.5 g/l potassium phosphate dibasic, 4.5 g/l potassium phosphate monobasic anhydrous, 1 g/l ammonium sulfate, 0.5 g/l sodium citrate dehydrate, 10 g/l sucrose, 1 mM magnesium sulfate) and 30 μL spectinomycin (50 mg/mL) and 30 μL acetosyringone (20 mg/mL). A half loopful of *Agrobacterium* from a second plate was suspended into the flasks and placed on an orbital shaker set at 200 rpm and incubated at 28° C. overnight. The *Agrobacterium* culture was centrifuged at 5000 rpm for 10 min. The supernatant was removed and the *Agrobacterium* infection medium (700 A) with acetosyringone solution was added. The bacteria were resuspended by vortex and the optical density (550 nm) of the *Agrobacterium* suspension was adjusted to a reading of about 0.35 to 2.0.

D. Maize Transformation.

Ears of a maize (*Zea mays* L.) cultivar were surface-sterilized for 15-20 min in 20% (v/v) bleach (5.25% sodium hypochlorite) plus 1 drop of Tween 20 followed by 3 washes in sterile water. Immature embryos (IEs) were isolated from ears and were placed in 2 ml of the *Agrobacterium* infection medium (700 A) with acetosyringone solution. The optimal size of the embryos varies based on the inbred, but for transformation with WUS2 and ODP2 a wide size range of immature embryo sizes could be used. The *Agrobacterium* infection medium (810K) was drawn off and 1 ml of the *Agrobacterium* suspension was added to the embryos and the tube was vortexed for 5-10 sec. The microfuge tube was allowed to stand for 5 min in the hood. The suspension of *Agrobacterium* and embryos were poured onto 7101 (or 562V) co-cultivation medium (see Table 8). Any embryos left in the tube were transferred to the plate using a sterile spatula. The *Agrobacterium* suspension was drawn off and the embryos placed axis side down on the media. The plate was incubated in the dark at 21° C. for 1-3 days of co-cultivation.

Embryos were transferred to resting medium (605T medium) without selection. Three to 7 days later, the embryos were transferred to maturation medium (289Q medium) supplemented with a selective agent.

Example 5: *Agrobacteria* Mixtures for Recovery of Maize Transgenic Events Containing Only the Trait Expression Cassette T-DNA The following experiments demonstrated that delivery of a plasmid containing WUS2 along with the plasmid containing a trait expression cassette improved recovery of transgenic T0 plants containing only the trait T-DNA and no vector (plasmid) backbone.

Immature embryos of maize Non-Stiff-Stalk inbred HC69 were transformed with *Agrobacterium* strain LBA4404 THY—(See U.S. Pat. No. 8,334,429 incorporated herein by reference in its entirety) (Agro1) containing PHP86491, a T-DNA with two "Trait" (ZS-GREEN and ZM-HRA) expression cassettes (Table 7). This *Agrobacterium* (Agro1) was used alone (Control Treatment) to infect the immature embryos, or as part of a mixture with another *Agrobacterium* (Agro2) containing a WUS expression cassette (PHP87598, PHP88156, PHP88157, or PHP88158, see Table 7). For Treatments (Trts) 1-4, the two *Agrobacteria* were mixed at a ratio of 95% Trait-containing PHP86491 plasmid (Agro1) to 5% WUS-containing plasmid (Agro2) (PHP87598, PHP88156, PHP88157, or PHP88158, see Table 7). As shown in Table 11 below, when only the *Agrobacterium* containing the Trait T-DNA (PHP86491) plasmid (Agro1) was used for transformation, the frequency of recovering T0 plants with a single-copy of the T-DNA and no plasmid backbone (sequence outside the T-DNA borders) was low (Trt C=1.8%). However, when a second *Agrobacterium* (Agro2) containing a T-DNA with a WUS expression cassette (PHP87598, PHP88156, PHP88157, or PHP88158, see Table 7) was mixed in at a low titer with Agro1, the recovery of transgenic T0 plants containing only a single copy of the Trait T-DNA (PHP86491-ZS-GREEN+ZM-HRA) with no integration of the WUS-containing T-DNA (PHP87598, PHP88156, PHP88157, or PHP88158, see Table 7) or plasmid backbone was observed at substantially improved frequencies (6.4% to 16.2% for Trts 1-4 in Table 11). For Trt1 in which the T-DNA in Agro2, PHP87598, contained three viral enhancer elements (ENH) 5' to the ZM-PLTP promoter driving WUS expression along with a heat-shock promoter driving CRE expression, a constitutively-expressed anthocyanin expression cassette (NOS PRO::CRC::SB-GKAF TERM) and loxP sites flanking all three expression cassettes, the frequency of integration of a single-copy of the Trait T-DNA and no plasmid backbone was 6.5%. For PHP88156, PHP88157 and PHP88158, which all contained a WUS expression cassette with a 3×ENH:PLTP promoter (with or without a maize-derived enhancer element (EME) positioned near the PLTP promoter TATA box (in triplicate (3×EME in PHP88156), as a single copy (EME in PHP88157) or with no EME (EME—in PHP88158)) driving WUS and the constitutively-expressed anthocyanin expression cassette, the frequency of T0 plants containing only a single-copy of the Trait T-DNA and no plasmid backbone was 6.4 (PHP88156), 16.2 (PHP88157) and 12.1%

(PHP88158). Escapes (regenerated non-transgenic T0 plants) were 4% when Agro2 contained PHP88157 and 1% when Agro2 contained PHP88158. The 3×ENH have an effect on the NOS PRO::CRC::SB-GKAF TERM expression cassette and if the T-DNA containing the ENH and NOS PRO::CRC::SB-GKAF TERM expression cassette integrated, the embryos were deep red in color and failed to produce plantlets. Treatments 2-4 (Table 11) demonstrated that mixing a second *Agrobacterium* containing a WUS expression cassette at low titer (5% relative to Agro1 containing the Trait-T-DNA) provided an effective alternative for enhancing the recovery of T0 plants containing only a single-copy of the Trait T-DNA and no plasmid backbone without the need to follow-up the transformation process with excision of the WUS expression cassette.

TABLE 11

| Trt. | "Trait" Plasmid in Agro1 | WUS-containing Plasmid in Agro2 | Frequency of Escapes (%) | Frequency of Single-copy, no backbone (%) |
|---|---|---|---|---|
| C | PHP86491 | None | 0 | 1.8 |
| 1 | PHP86491 | PHP87598 | 0 | 6.5 |
| 2 | PHP86491 | PHP88156 | 0 | 6.4 |
| 3 | PHP86491 | PHP88157 | 4 | 16.2 |
| 4 | PHP86491 | PHP88158 | 1 | 12.1 |

Immature embryos of maize Stiff-Stalk inbred PH1V69, disclosed in U.S. Pat. No. 8,907,160 and incorporated herein by reference in its entirety, were transformed with *Agrobacterium* strain LBA4404 THY- (Agro1) containing PHP86491 (Table 7). This *Agrobacterium* (Agro1) was used alone (Control Treatment) to infect the immature embryos, or as part of a mixture with another *Agrobacterium* (Agro2) containing a WUS expression cassette (PHP87598 or PHP88156 or PHP88157 or PHP88157) (95% Agro1 to 5% Agro2).

In the Control Treatment (Agro1 alone), no escapes (regenerated non-transgenic T0 plants) were recovered and no T0 plants were recovered that contained only a single-copy of the Trait T-DNA and no plasmid backbone. In contrast, when a second *Agrobacterium* (Agro2) containing PHP87598 (Table 7) was mixed in with Agro1 and the mixture was used for transformation, there were still no escapes recovered and the frequency of T0 plants containing only a single-copy of the Trait T-DNA and no plasmid backbone was 16.5%. When PHP87078 (Table 7) was substituted in place of PHP87598 in Agro2, no escapes were observed in the regenerated T0 plants and the frequency of T0 plants containing only a single-copy of the Trait T-DNA and no plasmid backbone was 7.1%. These frequencies represented a major improvement in our ability to use morphogenic gene expression cassettes (e.g. 3×ENH:PLTP::WUS2) without integration of the WUS-containing expression cassette to recover high-quality T0 plants (single-copy for Traits with no extraneous sequences being integrated (no plasmid backbone or any T-DNA sequence from Agro2).

Immature embryos of maize Stiff-Stalk inbred PH1V69 were transformed with *Agrobacterium* strain LBA4404 THY-containing plasmid PHP86491 (Table 7). This *Agrobacterium* (Agro1) was used as part of a mixture with another *Agrobacterium* (Agro2) containing plasmid PHP87598 (Table 7), which contained a WUS expression cassette. Two different ratios of Agro1:Agro2 were tested, either 50:50 or 90:10. When the 50:50 mixture was used for transformation, no escapes were observed in the resultant T0 plants and a frequency of T0 plants containing only a single-copy of the Trait T-DNA and no plasmid backbone was 8.2%. When the 90:10 mixture was used for transformation, no escapes were observed in the resultant T0 plants and a frequency of T0 plants containing only a single-copy of the Trait T-DNA and no plasmid backbone was 26%. This result demonstrated that the relative concentration of Agro1 and Agro2 in the transformation mix impacted the frequency of T0 plants containing only a single-copy of the Trait T-DNA and no plasmid backbone.

Immature embryos from four different tropical maize inbreds were harvested and transformed with one of two "Trait" expression cassettes using PHP81561 (ZS-YELLOW+NPTII) or PHP86491 (ZS-GREEN and ZM-HRA). For all four inbreds, PH2KD1, PH44MH, PH4BAH and PH28SV, the transformation rate with either G-418 selection or imazapyr selection (for the NPTII or HRA genes, respectively) was effectively 0%. However, when a second *Agrobacterium* containing (PHP88158, see Table 7) was added at a titer of 10% relative to the Trait-containing Agro1 (containing PHP81561, see Table 7) and G-418 selection was used throughout somatic embryo maturation and germination, the frequency of T0 plants recovered with only a single copy of the T-DNA and no vector (plasmid) backbone was 30% for PH2KD1, 38% for PH44MH, 43% for PH4BAH and 3.2% for PH28SV, relative to the number of starting embryos. When the second *Agrobacterium* containing PHP88158 was added at a titer of 10% relative to the ZS-GREEN and ZM-HRA-containing Agro1 (containing PHP86491) and 0.1 mg/l imazapyr selection was used throughout somatic embryo maturation and germination, the frequency of T0 plants recovered with only a single copy of the T-DNA and no vector (plasmid) backbone was 15% for PH2KD1, 18% for PH44MH, 9.6% for PH4BAH and 0% for PH28SV, relative to the number of starting embryos. These results demonstrated that using a WUS-expressing cassette within the T-DNA of Agro2 and mixing Agro2 at 10% relative to the Trait-containing Agro1 (90%) resulted in an effective method for integrating the Trait-T-DNA resulting in the recovered T0 plants containing only a single copy of the T-DNA and no vector (plasmid) backbone at extremely efficacious frequencies.

Example 6: Using a WUS2 Expression Cassette Outside the Trait-Containing T-DNA Borders to Stimulate Transformation and Selection of Single-Copy T0 Maize Plants that Contained No WUS2 Expression Cassette Integrated in Chromosomal DNA For these experiments, a set of three plasmid designs was tested. All three plasmids contained the same T-DNA (RB+LOXP+SI-UBI3 PRO::ZS-GREEN1::PINII TERM+SB-ALS PRO::ZM-HRA::SB-PEPC1 TERM+LB) but differed in the WUS2 or WUS2/ODP2 expression cassettes beyond the left border. Specifically, PHP86295 contained two expression cassettes immediately outside the Left Border, ZM-PLTP PRO::ZM-WUS2::IN2-1 TERM+ZM-PLTP PRO::ZM-ODP2::OS-T28 TERM (See Table 7), PHP86296 contained a single expression cassette immediately outside the Left Border, ZM-PLTP PRO::ZM-WUS2::IN2-1 TERM, and PHP86297 contained a single expression cassette immediately outside the Left Border, ZM-PLTP PRO::ZM-WUS2~T2A~ZM-ODP2::OS-T28 TERM. For Pioneer Stiff-Stalk inbred PH1V69, after *Agrobacterium*-mediated transformation with these respective T-DNAs, and selection on 0.05 to 0.1 mg/l imazapyr during somatic embryo maturation and regeneration, T0 plants were analyzed by qPCR. Based on qPCR analysis, using PHP86295 resulted in 10.2% of the recovered T0 plants being single copy for the Trait genes within the T-DNA while lacking integrated WUS and/or ODP2 with no plasmid backbone contamination, these values were 12.2% and 12.3% for PHP86296 and PHP86297, respectively. These results demonstrated that positioning the WUS2 and/or ODP2 expression cassettes outside the T-DNA Left Border provided the necessary stimulation of transformation without the concomitant integration of these morphogenic gene expression cassettes. This result further demonstrated that WUS and/or ODP2 could be transiently expressed after "beyond-the-border" delivery to stimulate maize transformation. In contrast, using these same vectors in inbred HC69 did not result in an increased recovery of single-copy Trait T-DNA events with no vector (plasmid) backbone, this is likely due to the propensity of this inbred to produce multi-copy integration events with a high degree of border read-though.

Example 7: Use of Multiple Left Borders Between the T-DNA and the Morphogenic Gene Expression Cassettes Increase the Frequency of Single-Copy Trait T-DNA Integration Events Maize inbreds vary in many morphological and physiological characteristics. One manifestation of this variability is the susceptibility of the immature embryo scutellum of different inbreds to T-DNA delivery and integration during *Agrobacterium* infection and co-cultivation. For example, when *Agrobacterium* strain LBA4404 THY—is used to transform Pioneer inbred HC69, a high frequency of recovered transgenic T0 plants contain multiple copies of the T-DNA and have undergone read-through at the T-DNA Left Border (LB) resulting in the integration of vector (plasmid) backbone. Introducing multiple left borders will mitigate this tendency. As an example, multiple left borders are introduced into PHP86296 in between the Trait-containing T-DNA and the flanking WUS2 expression cassette, resulting in the following configuration: RB+LOXP+SI-UBI3 PRO::ZS-GREEN1::PINII TERM+SB-ALS PRO::ZM-HRA::SB-PEPC1 TERM+LB+LB+LB+ZM-PLTP PRO::ZM-WUS2::IN2-1 TERM. When LBA4404 containing the above multiple-LB T-DNA and flanking WUS2 expression cassette is used to transform HC69, it is expected that a substantially higher frequency of the recovered T0 plants will be single-copy for the T-DNA with no integrated WUS2 expression cassette and containing no plasmid backbone.

Example 8: Mutagenesis of the Left Border Sequence Increases the Frequency of Recovering Transgenic Events Maize inbreds vary in many morphological and physiological characteristics. One manifestation of this variability is the susceptibility of the immature embryo scutellum of different inbreds to T-DNA delivery and integration during *Agrobacterium* infection and co-cultivation. For example, when *Agrobacterium* strain LBA4404 THY—is used to transform Pioneer inbred PH28SV, very few cells in the scutellum receive a LB-flanking sequence such as the flanking WUS2 expression cassette, and thus are not stimulated to rapidly form new somatic embryos. By selectively mutagenizing the LB sequence, the efficacy of the LB can be altered to permit a higher frequency of LB read-through. When used for transformation, it is expected that a higher frequency of rapidly forming somatic embryos and resultant T0 plants containing a single copy trait gene with no vector (plasmid) backbone will be produced.

*Agrobacterium* co-cultivation of varieties more recalcitrant to infection could make beyond the border delivery for expression of morphogenic genes impractical. It is anticipated that the use of more aggressive *Agrobacterium* strains such as AGL1, EHA101, EHA105 or any strain possessing the supervirulent Ti-plasmid pTiBo54 could be used to address this potential shortcoming. In addition, the use of a binary vector with a higher copy number could be used to deliver an increased number of T-DNA molecules per cell thus amplifying beyond border read-through and subsequent morphogenic gene expression.

Example 9: Plasmid Mixtures for Recovery of Canola Transgenic Events Containing Only the Trait T-DNA Canola seed is surface-sterilized and germinated on half-strength MS medium to produce sterile, one-week old plants. The hypocotyls are placed in 10 ml of 20A medium (Table 9) and diced into 2 mm segments. *Agrobacterium* strain LBA4404 THY—is suspended in 20A medium and adjusted to 0.6 OD550 and 10-200 μl of this suspension is added to each plate containing the hypocotyls.

The hypocotyl segments are transformed with *Agrobacterium* strain LBA4404 THY-(Agro1) containing PHP88193, a T-DNA with two "Trait" (SPCN and ZS-YELLOW1 N1) expression cassettes (Table 7). This *Agrobacterium* (Agro1) is used alone (Control Treatment) to infect the hypocotyl segments, or as part of a mixture with another *Agrobacterium* (Agro2) containing PHP90094 (SEQ ID NO: 116), an HA-WUS expression cassette (Table 7). The mixture contains 95% of Agro1 and 5% of Agro2. After co-cultivation with the *Agrobacterium* in 20A medium (Table 9) under low light and 21° C., the hypocotyl segments are transferred onto a progression of selection media starting with 70A medium (Table 9) for two weeks, 70B medium (Table 9) for an additional two weeks, and then onto 70C medium (Table 9) for two weeks. For continued germination and rooting, small shoots are transferred onto solid medium consisting of half-strength MS salts, 10 g/l sucrose, 0.5 mg/l IBA and 5 g/l TC agar adjusted to pH 5.7. Once adequate roots have formed the plantlets are transferred to soil in the greenhouse.

In the Control Treatment with Agro1 alone, it is expected that no escapes (regenerated non-transgenic T0 plants) will be recovered due to stringent selection on spectinomycin, the frequency of recovering transgenic T0 plants will be low (i.e. <1.5%), the timeframe from *Agrobacterium* infection to recovery of T0 plantlets will typically take between 3-4 months, and the frequency of T0 plants that contain only a single-copy of the Trait T-DNA and no vector (plasmid) backbone will be low. In contrast, when a second *Agrobacterium* (Agro2) containing PHP90094 is mixed with Agro1 and the mixture is used for transformation, it is expected that i) no escapes will be recovered, ii) the frequency of recovering transgenic T0 plants will be increased, iii) the timeframe from *Agrobacterium* infection to recovery of T0 plants will be substantially reduced, and iv) the frequency of T0 plants that contain only a single-copy of the Trait T-DNA with no vector (plasmid) backbone will be substantially increased.

Example 10: Using a WUS2 Expression Cassette Outside the Trait-Containing T-DNA Borders to Stimulate Transformation and Selection of Single-Copy T0 Canola Plants that Contain No WUS2 Expression Cassette Transformation is performed using a single *Agrobacterium* strain containing a single T-DNA, with the "Trait" expression cassettes within the T-DNA right and left borders, and a WUS expression cassette just outside the left border. For example, a plasmid (PHP0001, see Table 7) containing an enhanced-35S PRO::WUS expression cassette with the following configuration can be used: RB+AT-UBQ10 PRO::CTP::SPCN::UBQ14 TERM+GM-UBQPRO::ZS-YELLOWN1::NOSTERM+LB+FMV ENH: PSCV ENH:MMV ENH:CAMV35S PRO::HA-WUS::OS-T28 TERM.

For the Control Treatment, PHP88193, in which the T-DNA contains the SPCN and ZS-YELLOW N1 expression cassettes with no WUS expression cassette, it is expected that no escapes (regenerated non-transgenic T0 plants) will be recovered due to stringent selection on spectinomycin, the frequency of recovering transgenic T0 plants will be low (i.e. <1.5%), the timeframe from *Agrobacterium* infection to recovery of T0 plantlets will typically take between 3-4 months, and the frequency of T0 plants that contain only a single-copy of the Trait T-DNA and no vector (plasmid) backbone will be low. In contrast, when the enhanced-35S PRO::WUS expression cassette described above is added to the plasmid immediately outside the LB of the T-DNA, after *Agrobacterium*-mediated transformation it is expected that i) no escapes will be recovered, ii) the frequency of recovering transgenic T0 plants will be increased, iii) the timeframe from *Agrobacterium* infection to recovery of T0 plants will be substantially reduced, and iv) the frequency of T0 plants that contain only a single-copy of the Trait T-DNA with no integrated WUS or vector (plasmid) backbone will be substantially increased.

Example 11: WUS Expression Cassette Located 3' to the Left Border Improves Recovery of Transgenic Soybean Events Containing the Components within the T-DNA For this experiment, a binary vector containing the PVS1 origin of replication and a single T-DNA was constructed. A control vector (PHP80728) having two expression cassettes within the T-DNA right and left borders was constructed. The first expression cassette consisted of the soybean UBQ promoter driving expression of TAG-RFP, followed by the *Arabidopsis* UBQ3 terminator. The second expression cassette consisted of the soybean SAMS promoter driving expression of a soybean herbicide resistant ALS gene (HRA) and the soybean ALS terminator.

A second vector (PHP81718) was constructed containing the same herbicide resistant ALS gene and identical TAG-RFP expression cassettes located within the T-DNA, and additionally contained an expression cassette beyond the left border: GM-EF1A PRO::AT-WUS::UBQ14 TERM. These two plasmids were introduced into *Agrobacterium* strain AGL1 for comparison.

After transformation of immature cotyledons of Pioneer soybean variety 93Y21 with either the control T-DNA plasmid (PHP80728) or the WUS beyond the Left Border T-DNA plasmid (PHP81718), the cotyledons were cultured for two weeks, moved onto M5 maturation medium supplemented with the selective herbicide 10 μg/1 chlorsulfuron before sending T0 plantlets to the greenhouse. T0 plants were sampled and PCR screened for the presence of the ALS, TAG-RFP and WUS expression cassettes.

The WUS beyond the Left Border T-DNA plasmid (PHP81718) greatly improved the efficiency of somatic embryogenesis (See FIG. 1), increasing the efficiency of embryo formation from a median value of less than 5% in the TAG-RFP control (PHP80728) to over 25% in the WUS treatment (PHP81718). This directly translated into an increased frequency of transgenic mature somatic embryos capable of germinating to form transgenic T0 plants.

Transformation using the TAG-RFP control vector (PHP80728) produced no T0 plants. By comparison, the WUS treatment (PHP81718) produced some T0 plants. Six T0 plants were analyzed by qPCR and four T0 plants contained the ALS and TAG-RFP expression cassettes while lacking integrated WUS and with no plasmid backbone contamination. This result demonstrated that WUS could be transiently expressed after "beyond-the-border" delivery along with the integrated T-DNA at high enough levels to stimulate somatic embryo formation, without being integrated into the genome. This provided an efficient method for using WUS for rapid production of transgenic soybean events (carrying traits ALS and TAG-RFP) without having to excise the WUS expression cassette because it was only transiently expressed and was never integrated.

Example 12: Using Both a WUS2 Expression Cassette and a Wheat Dwarf Virus RepA Expression Cassette Outside the Trait-Containing T-DNA Borders to Stimulate Transformation and Selection of Single-Copy T0 Maize Plants that Contained No WUS2 or RepA Expression Cassettes For these experiments, two plasmids are compared. The first contains a T-DNA comprising the following components; RB+LOXP+SI-UBI3 PRO::ZS-GREEN1::PINII TERM+SB-ALS PRO::ZM-HRA::SB-PEPC1 TERM+LB with one additional expression cassette immediately beyond the left border; ZM-PLTP PRO::ZM-WUS2::IN2-1 TERM (See PHP86296 in Table 7). The second plasmid contains a T-DNA comprising the following components; RB+LOXP+SI-UBI PRO::ZS-GREEN1::PINII TERM+SB-ALS PRO::ZM-HRA::SB-PEPC1 TERM+LB with two additional expression cassettes immediately beyond the left border; ZM-PLTP PRO::ZM-WUS2::IN2-1 TERM+ZM-PLTP PRO::WDV-RepA::OS-T28 TERM (See PHP0002 in Table 7) (WDV-RepA is wheat dwarf virus RepA see U.S. Pat. No. 6,284,947 incorporated herein by reference in its entirety). For the Pioneer Stiff-Stalk inbred PH1V69, after *Agrobacterium*-mediated transformation with these respective T-DNAs, and selection on 0.05 to 0.1 mg/l imazapyr during somatic embryo maturation and regeneration, T0 plants are analyzed by qPCR. When using PHP86296 it is expected that the frequency of recovering T0 plants (relative to the number of starting immature embryos) that are single copy for the Trait genes within the T-DNA with no vector (plasmid) backbone will be approximately 10%. When PHP0002 is used in the *Agrobacterium*, it is expected that transformation frequencies will be higher than the control (PHP86296), the growth of transgenic somatic embryos will be accelerated and the frequency of recovering T0 plants that are single copy for the Trait genes within the T-DNA while lacking integrated WUS and RepA and no vector (plasmid) backbone will be increased relative to the control (PHP86296) treatment. It is expected that positioning the WUS2 and RepA expression cassettes outside the T-DNA Left Border will provide an improved stimulation of transformation without the concomitant integration of these morphogenic gene expression cassettes.

Alternatively, a T-DNA containing a single expression cassette outside the LB comprising RB+SI-UBI PRO::ZS-GREEN::PINII TERM+SB-ALS PRO::ZM-HRA::SB-PEPC1 TERM+LB+ZM-PLTP PRO::WUS2~T2A~WDV-RepA::IN2-1 TERM (PHP0005) is expected to be equally effective with higher transformation frequencies than the control, with accelerated growth of transgenic somatic embryos, and with an increased frequency of recovering T0 plants that are single copy for the Trait genes within the T-DNA while lacking integrated WUS and RepA and no vector (plasmid) backbone relative to the control treatment.

Example 13: Using Both a WUS2 Expression Cassette and a amiRNA Expression Cassette Targeting the Maize PICKLE (PKL) Transcript Outside the Trait-Containing T-DNA Borders to Stimulate Transformation and Selection of Single-Copy T0 Maize Plants that Contained No WUS2 or RepA Expression Cassettes For these experiments, two plasmids are compared. The first, PHP86296 contains a T-DNA comprising the following components; RB+LOXP+SI-UBI3 PRO::ZS-GREEN1::PINII TERM+SB-ALS PRO::ZM-HRA::SB-PEPC1 TERM+LB with one additional expression cassette immediately beyond the left border; ZM-PLTP PRO::ZM-WUS2::IN2-1 TERM.

The second plasmid contains a modified PHP86296 with one additional expression cassette, ZM-PLTP PRO::PKLamiRNA::OS-T28 TERM, outside the Left Border (PHP0003 in Table 7). The PKLamiRNA component is an artificial micro-RNA that targets a short sequence in the maize PICKLE (PKL) transcript which destabilizes the PKL transcript causing degradation. For the Pioneer Stiff-Stalk inbred PH1V5T, after *Agrobacterium*-mediated transformation with these respective T-DNAs, and selection on 0.05 to 0.1 mg/l imazapyr during somatic embryo maturation and regeneration, T0 plants are analyzed by qPCR. It is expected that using PHP86296 will result in the recovery of T0 plants that are single copy for the Trait genes within the T-DNA and will lack integrated WUS and PKLamiRNA with no plasmid backbone at a frequency of about 1% (relative to the number of starting immature embryos). When PHP0003 is used in the *Agrobacterium*, it is expected that transformation frequencies will be higher than for PHP86296, the growth of transgenic somatic embryos will be accelerated and the frequency of recovering T0 plants that are single copy for the Trait genes within the T-DNA while lacking integrated WUS and RepA and with no plasmid backbone will be increased relative to the PHP86296 treatment.

When the *Agrobacterium* containing these two plasmids is used to transform maize leaf tissue from the inbred PH1V5T, followed by selection on 0.05 to 0.1 mg/l imazapyr during somatic embryo maturation and regeneration, T0 plants are analyzed by qPCR. It is expected that using PHP86296 will result in the recovery of transgenic callus and that after two to three weeks somatic embryos will be formed at a frequency of about 1% (relative to the number of starting immature embryos). When PHP0003 is used in the *Agrobacterium*, it is expected that transformation frequencies will be higher than for PHP86296, the somatic embryos will rapidly form directly from leaf cells (with no intervening callus stage) and the frequency of recovering T0 plants that are single copy for the Trait genes within the T-DNA while lacking integrated WUS and PKLamiRNA and no vector (plasmid) backbone will be increased relative to the PHP86296 treatment.

Example 14: Using a Constitutively-Expressed Tetracycline Repressor Outside the Trait-Containing T-DNA Borders Along with a Repressible Promoter Driving Expression of moPAT~DsRED within the T-DNA to Promote Recovery of Single-Copy Bialaphos-Resistant Events that do not Contain the Repressor Expression Cassette Immediately Beyond the LB For these experiments, the plasmid PHP38042 (See Table 7) contains a T-DNA comprising the following components; RB+CAMV35S PRO:3×TET-OP:ADH1 INTRON1::MO-PAT~DS-RED EXPRESS::PINII TERM+LB+UBI1ZM PRO::TET REPRESSOR::PINII TERM.

For the Pioneer Stiff-Stalk inbred PH1V5T, after *Agrobacterium*-mediated transformation with this T-DNA, and selection on 3.0 mg/l bialaphos during somatic embryo maturation and regeneration, T0 plants are analyzed by qPCR. It is expected that using PHP38042 will result in the recovery of T0 plants that are single copy for the Trait genes within the T-DNA and will lack integrated TET REPRESSOR with no plasmid backbone at a frequency of about 3-5% (relative to the number of starting immature embryos), and T0 plants that lack the integrated TET REPRESSOR will be herbicide tolerant and express DS-RED.

Example 15: Using Both a WUS2 Expression Cassette and a Constitutively Expressed dCAS~Repressor (REP) Fusion Expression Cassette Outside the Trait Gene-Containing T-DNA Borders to Stimulate Transformation and Selection of Single-Copy T0 Maize Plants that Contain No WUS2 or RepA Expression Cassettes For these experiments, two plasmids are compared. The first contains a T-DNA comprising the following components: RB+SI-UBI3 PRO::ZS-GREEN1::PINII TERM+SB-ALS PRO::ZM-HRA::SB-PEPC1 TERM+LB (the Control Plasmid). The second plasmid contains the same components within the T-DNA (RB+SI-UBI3 PRO::ZS-GREEN1::PINII TERM+SB-ALS PRO::ZM-HRA::SB-PEPC1 TERM+LB) plus three additional expression cassette immediately beyond the left border: i) an expression cassette containing ZM-U6 PRO::gRNA::ZM-U6 TERM; ii) ZM-UBI PRO::dCAS9~REP::PINII TERM expression cassette; and iii) a PLTP PRO::ZM-WUS2::IN2-1 TERM expression cassette (the Test Plasmid). The gRNA within the first expression cassette has been designed to target the dCAS9~REP to the SB-ALS PRO sequence which transcriptionally silences HRA expression and renders the cell sensitive to imazapyr.

For the Pioneer Stiff-Stalk inbred HC69, after *Agrobacterium*-mediated transformation with *Agrobacterium* strain LBA4404 THY-containing the control plasmid, during somatic embryo maturation and regeneration, T0 plants are analyzed by qPCR. Using the control plasmid in the *Agrobacterium*, it is expected that the frequency of recovering T0 plants (relative to the number of *Agrobacterium*-infected immature embryos) that are single copy for the Trait genes within the T-DNA with no vector (plasmid) backbone will be approximately 5%. When the Test plasmid is used in the *Agrobacterium*, it is expected that transformation frequencies will be higher than the control, the growth of transgenic somatic embryos will be accelerated and the frequency of recovering T0 plants that are single copy for the Trait genes within the T-DNA while lacking integrated WUS and dCAS9~REP and no vector (plasmid) backbone will be increased relative to the control treatment. It is expected that positioning the dCAS9~REP and the WUS2 expression cassettes outside the T-DNA Left Border will provide an improved stimulation of transformation without the concomitant integration of these morphogenic gene expression cassettes.

Alternatively, a synthetic Zinc-Finger Nuclease fused to a repressor domain can be used in place of the gRNA and dCAS9~REP (Urritia et al., 2003, Genome Biol. 4:231) in the above example.

Example 16: Transformation of Cotton

Delinted Cotton (*Gossypium hirsutum*) cv. Coker 310 and 312 seeds were surface sterilized using 40% (v/v; 80 ml bleach and 120 ml water) commercial bleach and 1 drop of Triton X-100, for 30 min and rinsed with sterile water three times with 2 minute intervals. After bleach treatment seeds were rinsed with 95% ethanol for 1 minute and again rinsed 3 times with sterile water. Then seeds were placed on a sterile paper towel to blot the seeds.

Twenty surface-sterilized seeds were germinated in 'Cotton Seed Medium' (CSM; (GH3210)) containing ½ strength MS salts (2.2 g/L), ½ strength B5 vitamins, 0.9 g/L magnesium chloride hexahydrate, 15 g/L glucose, 3.6 g/L Phytagel (Sigma)) with pH adjusted to 5.8, at 28° C., with 5 seeds per phytatray, and incubated in dark for about 7-9 days.

After about 3 days, when the seed coats split and the radicles emerged. The seed coats were removed by using sterile forceps, gently pinching the rounded tip (chalazas) of all the seed at the surface of the media to expose the folded cotyledons, and the radicles were inserted into the media. The phytatrays were again incubated at 28° C. to complete germination. After 8 days, hypocotyls and cotyledon explants were cut from seedlings using scissors. Hypocotyl and cotyledon explants were placed in a sterile petri plate and using a scalpel blade were cut into 0.9 cm segments (for hypocotyls) and 0.5 sq·cm segments (for cotyledons). The segments were then placed in a sterile 100×25 mm (width×depth) Petri dish with 35 ml of liquid co-cultivation medium (MS salts, B5 vitamins, 30 g/L glucose, 0.9 g/L magnesium chloride hexahydrate, 1.9 g/L potassium nitrate, 0.1 g/L myo-inositol, pH 5.8) in preparation for *Agrobacterium* treatment.

In this experiment, the plasmid PHP89484 contained the T-DNA with the following components: RB+AT-UBQ10 PRO::CTP::SPCN::UBQ14 TERM+GM-UBQ PRO::DS-RED2::UBQ3 TERM+LB+CAMV35S PRO::HA-WUS::OS-T28 TERM+FMC ENH::PCSV ENH::MMV ENH. The control plasmid (PHP88193) in which a WUS expression cassette was not present contained a T-DNA with the following components; RB+AT-UBQ10 PRO::CTP::SPCN::UBQ14 TERM+GM-UBQ PRO::ZS-YELLOW1 N1::NOS TERM+LB.

*Agrobacterium* strain LBA4404 containing PHP89484 was prepared in 810K minimal medium plus 100 ug/ml spectinomycin and 200 µM acetosyringone. The *Agrobacterium* culture was grown in an incubator shaker at 28° C. and 280 rpm, overnight until reaching an OD at 600 nm of 0.6-0.8. Bacterial cells were pelleted by centrifugation at 4000 rpm for 15 min and resuspended in 700A medium to a final OD600 of 0.6. Forty ml of the *Agrobacterium* solution was added into each Petri dish containing the cut segments and incubated for 30 minutes with intermittent shaking.

Following infection, approximately 50 hypocotyl segments or 50 cotyledon explants were placed in petri dishes with solid 7101 co-cultivation medium and covered with a sterile filter paper. Co-cultivation was carried out for four days at 28° C. under low light (5 µE) with a 16 h photoperiod. The explants were then transferred directly to the surface of 'Callus Induction Medium' (CIM) (MS salts, B5 vitamins, 30 g/L glucose, 0.9 g/L magnesium chloride hexahydrate, 1.9 g/L potassium nitrate, 0.1 g/L myo-inositol, 0.1 mg/L kinetin, 0.1 mg/L (0.45 µM) 2, 4-D, 500 mg/L carbenicillin, 3.6 g/L Phytagel (pH 5.8)) with no selection agent. After 14 days the explants were transferred to CIM with 60 mg/l Spectinomycin.

After 7 days of Agro treatment, transient RFP expression was observed under an epifluorescent stereomicroscope. Strongly expressing DS-RED foci were observed in both cotyledon and hypocotyl explants all around the cut surface. DS-RED expression was observed in stable callus which showed multicellular DS-RED expressing structures after 3 weeks. In comparison, when a control T-DNA (in PHP88193) was used in the same strain and under the same experimental conditions, T-DNA delivery was similar based on fluorescence but at three weeks after Agro treatment, no growth of multicellular structures was observed.

Example 17: Using Viral Enhancers with the Barley LTP2 PRO to Drive WUS2 Expression Further Improves Recovery of Single Copy Transgenic Events for Only the "Trait" T-DNA

*Agrobacterium* strain LBA4404 THY-containing the virulence plasmid PHP71539 (SEQ ID NO: 132) was used in all treatments. PHP86491 (SEQ ID NO: 110) containing a T-DNA with the "Trait" expression cassettes (RB+SB-UBI PRO::ZS-GREEN1::OS-UBI TERM+SB-ALS PRO::ZM-HRA::PINII TERM+LB) was also used in all treatments. As a negative control, Treatment 1 (Trt. No. 1), a single *Agrobacterium* strain (Agro1) containing only PHP86491 was used. As a positive control, Treatment 2 (Trt. No. 2), a second *Agrobacterium* (Agro2) containing PHP88158 (SEQ ID NO: 109) (RB+FMV ENH:PSCV ENH:MMV ENH:ZM-PLTP PRO::ZM-WUS2::IN2-1 TERM+NOS PRO::CRC::SB-GKAF TERM+LB) was mixed with Agro1. Both *Agrobacteria* suspensions were adjusted to 0.7 OD550 and then mixed at a ratio of 90% Agro1 to 10% Agro2. In a third treatment, Treatment 3 (Trt. No. 3), PHP93161 (SEQ ID NO: 130) (RB+LOXP+FMV ENH:PCSV ENH:MMV ENH::LTP2 PRO::ZM-WUS2::IN2-1 TERM+NOS PRO::CRC::SB-GKAF TERM+LB) was used to replace PHP88158 in Agro2, and the ratio of Agro1/Agro2 was kept the same in both Trt. No. 2 and Trt. No. 3 (90%/10%).

In Trt. No. 1, three hundred fifty-eight (358) immature embryos of inbred HC69 were infected with the *Agrobacterium* mixture and produced ninety-one (91) transgenic T0 plants (25% transformation frequency), with 11% of those plants being single copy for the traits (relative to the starting number of embryos). In Trt. No. 2, both transformation frequency and single copy frequency were improved relative to Trt. No. 1 (from 25% to 31% and from 11% to 16%, respectively). The improvement in the final "Single-copy % for Traits" value was the ultimate measure of success in terms of delivery of high-quality fertile transgenic plants to the greenhouse. This value was impacted by the outcomes of a number of individual steps during the process, including the initial transformation frequency (producing a transgenic cell), the regeneration frequency (producing a plant from the transgenic cell) and finally molecular analysis. The molecular analysis confirmed that the transgenic plants i) were independent integration events, ii) contained a single copy of the desired T-DNA and its composite trait expression cassettes, iii) contained no T-DNA with the morphogenic gene expression cassette, and iv) contained no *Agrobacterium* plasmid backbone sequences. Each of these outcomes (transformation frequency, regeneration frequency and molecular quality control frequency) contributed to attrition moving through the process, and is summarized by the "Single-copy % for Traits" frequencies as shown in Table 12. Due to the importance of this final outcome—the frequency of producing high-quality fertile T0 plants—an improvement from 11% in Trt. No. 1 to 16% in Trt. No. 2 represented an important and substantial improvement to the overall transformation efficiency for this valuable Pioneer inbred.

As described above, in PHP93161 (SEQ ID NO: 130) the promoter used to express the ZM-WUS2 gene was switched from the ZM-PLTP promoter in Trt. No. 2 to the LTP2 promoter (Kalla et al., 1994, The Plant J. 6:849-860) in Trt. No. 3. Both plant promoters in Trt. No. 2 and Trt. No. 3 were preceded by three promoter enhancer elements from three separate viruses, namely, the Figwort Mosaic Virus, the Peanut Chlorotic Streak Virus, and the *Mirabilis* Mosaic Virus (the three enhancer element sequences in this order abbreviated "3×ENH" in Table 12). When the LTP2 promoter was used in Trt. No. 3, the transformation and "Single-copy % for Traits" frequencies both increased relative to Trt. No. 2 (from 31% to 45% and from 16% to 24%, respectively). This demonstrated that different promoters were useful in this strategy. It also reinforced the conclusion reached comparing Trt. No. 1 with Trt. No. 2; by mixing one *Agrobacterium* (containing trait expression cassettes within the T-DNA) with another *Agrobacterium* (containing the morphogenic gene expression cassette within the T-DNA), the overall frequency of producing high-quality fertile T0 plants (independent events based on PCR characterization) was increased when compared to using a single *Agrobacterium* containing the T-DNA with only Traits.

TABLE 12

| Trt. No. | Morphogenic Gene Expression Cassette | No. Imm. Embryos | No. of Tnx. T0 plants | Transformation Frequency | Single-copy % for Traits | Contained WUS/CRC |
|---|---|---|---|---|---|---|
| 1 | None | 358 | 91 | 25% | 11% | NA |
| 2 | 3xENH:ZM-PLTP:WUS2 | 370 | 113 | 31% | 16% | 0 |
| 3 | 3xENH:LTP2:WUS2 | 370 | 168 | 45% | 24% | 1 |

Table 12 shows transformation efficiencies when no Agro2 (morphogenic gene expression cassette) was present as in Trt. No. 1, or with the Agro2 containing a WUS2 gene expression cassette with two different promoters (Trt. No. 2 and Trt. No. 3). Transformation frequency was calculated based on the number of transgenic (Tnx) T0 plants recovered relative to the starting number of immature embryos. Single copy analysis for the trait genes (ZS-GREEN1 AND HRA) and for the morphogenic gene (WUS2) was determined using quantitative PCR to determine gene presence and copy number. T0 plants that contained only a single copy of the trait genes with no WUS2 gene were used to calculate the "Single-copy % for Traits" values relative to the starting number of immature embryos.

Example 18: Using a Mixture of a Trait-Containing *Agrobacterium* and a Morphogenic Gene-Containing *Agrobacterium* Improved Sunflower Embryo Axis Transformation

*Agrobacterium* strain LBA4404 THY—was used for sunflower (*Helianthus annuus* variety F1503LG) transformation. Mature dry sunflower seeds were sterilized in a bleach solution (10-15% v/v in water with one drop of Tween detergent) for fifteen (15) minutes and then rinsed three (3) times in sterile water. Seeds were imbibed overnight. The embryos were removed from the softened hulls. Once the embryos were isolated, incisions were made at the base of the cotyledons to facilitate embryo isolation thereby exposing the leaf primordia sheathing the apical meristem. The radical tip was left attached to the embryo. After isolation, embryo axes (EAs) were transferred to petri plates for infection. Two *Agrobacteria* (each containing a different T-DNA plasmid) were suspended in liquid infection medium. The first *Agrobacterium* harbored plasmid PHP92349 (SEQ ID NO: 131) with a T-DNA containing "Trait" expression cassettes for the SPCN (spectinomycin resistance) and DS-RED2 (fluorescence) genes, specifically containing RB+LOXP+GM-QBU PRO::CTP:SPCN::UBQ14 TERM+GM-EF1A2 PRO::DS-RED2::UBQ3 TERM+LOXP+LB. The second *Agrobacterium* harbored PHP90094 with a T-DNA containing a morphogenic gene expression cassette for HA-WUS, specifically containing RB+CAMV35S PRO::HA-WUS::OS-T28 TERM+FMV ENHANCER:PCSV ENHANCER:MMV ENHANCER+LB. Each of the *Agrobacterium* strains was suspended in 20A media and the concentration of the bacterial suspensions were adjusted to 0.5 OD550. The *Agrobacterium* suspensions were mixed together at a 1:1 ratio and five (5) mls of the suspension was added to the EAs to cover the explants. The EAs were then placed under vacuum with gentle agitation for twenty (20) minutes. The EAs were removed from the *Agrobacterium* and inserted radicle-end down into 272AC media (standard MS salts and vitamin levels (Murashige and Skoog, 1962, Physiol. Plant 15:473-497), 0.1 g/l myo-inositol, 50 mg/l thymidine, 100 uM acetosyringone, 0.1 mg/l BAP, 40 g/l sucrose, 6 g/l Bacto Agar, pH 5.6), leaving the apical dome above the 272AC medium, and placed under dim light at 21° C. for three days of co-cultivation. After co-cultivation, the EAs were transferred to 272AB spectinomycin selection media (standard MS salts and vitamin levels (Murashige and Skoog, 1962, Physiol. Plant 15:473-497), 0.1 g/l myo-inositol, 10 mg/l meropenum, 0.1 mg/l meta-topolin, 30 mg/l spectinomycin dihydrochloride, 0.1 ug/l, 40 g/l sucrose, 6 g/l Bacto Agar, pH 5.6) under full light at 28° C.

The EAs were allowed to grow, with periodic trimming of bleached leaves. Within approximately three weeks after exposure to spectinomycin, green sectors or whole green leaves were observed. This green tissue also expressed DS-RED, confirming that the T-DNA from PHP92349 had been integrated. For rooting, transgenic events were transferred to a Bio-Dome Sponge rooting material (Park Seed Co., 3507 Cokesbury Road, Hodges, SC). After transfer to the Bio-Dome Sponge rooting material, roots formed within one to three weeks and the plants were potted and transferred to the greenhouse or growth-chambers.

In the control experiment, where only a single *Agrobacterium* containing "Trait" plasmid PHP92349 was used, only three (3) transgenic T0 plants were recovered from eight hundred twenty three (823) *Agrobacterium*-infected EAs and resulted in a transformation frequency of 0.4%. When the 1:1 mixture of the *Agrobacterium* containing PHP92349 ("Trait" expression cassette) and the *Agrobacterium* containing PHP90094 (a morphogenic gene (WUS) expression cassette) was used, six transgenic T0 plants were recovered from three hundred seventy (370) *Agrobacterium*-infected EAs and resulted in a transformation frequency of 1.6%. Additionally, none of the "Trait"-containing transgenic T0 plants contained the morphogenic gene (WUS) expression cassette. This demonstrated that using a mixture of two *Agrobacteria* to confer the advantage of morphogenic stimulation without integration of the morphogenic gene expression cassette improved transformation efficiency in sunflower.

Example 19: Co-Delivery of Two T-DNA Plasmids from One Bacterial Strain

An alternative to delivering a trait gene expression cassette(s) and morphogenic gene expression cassette(s) using a mixture of two *Agrobacteria* (each containing one of the two plasmids), is to use a single *Agrobacterium* containing two different T-DNAs. This is accomplished by constructing a single plasmid that contains two T-DNAs or by using two separate plasmids with one containing a trait gene expression cassette(s) T-DNA and the other plasmid containing a morphogenic gene expression cassette T-DNA. Maize inbreds vary in many morphological and physiological characteristics. One manifestation of this variability is the susceptibility of the immature embryo scutellum of different inbreds to T-DNA delivery and integration during *Agrobacterium* infection and co-cultivation. For example, when plasmid mixtures contained in two bacterial strains are used to transform Non-Stiff-Stalk inbred HC69, many cells receive only one of the plasmids, and therefore are not stimulated to rapidly form new somatic embryos and produce transgenic events with a trait. Instead of different ratios of Agro1:Agro2 for delivering the plasmid mixtures, delivery of plasmid mixtures from the same bacterial cell can result in a higher frequency of cells receiving both T-DNAs and permit a higher frequency of transgenic event production. When used for transformation, it is expected that a higher frequency of rapidly forming somatic embryos and resultant T0 plants containing a single copy trait gene expression cassette T-DNA with no vector (plasmid) DNA and without integration of the morphogenic gene expression cassette T-DNA will be produced.

Example 20: Using T-DNA Plasmids with Different Origins of Replication for Modulating Plasmid Copy Number For these experiments, two different T-DNAs are delivered in varying ratios (relative to each other) from a single bacterial cell by harboring these T-DNAs on two plasmids with different origins of replication (ORI). The different ORIs vary in the number of the plasmids maintained with a bacterial cell. The different ORIs can be used for titrating the plasmid copy numbers to achieve different ratios of the plasmids in the same bacterial cell. In this experiment one designs a plasmid having one or more ORI selected from the following ORIs: BBR1 ORI; PSA ORI; PSA+PARDE ORI; PVS1 ORI; repABC ORI; RK2 ORI; RK2+PARDE ORI; or RSF1010 ORI (US Patent Publication 20180216123 and WO2017078836, incorporated herein by reference in their entireties) residing within the same bacterial cell. Within these various ORIs, it was previously determined that pVS1 confers high plasmid copy number (~20 copies/cell) and repABC confers low copy number (~1-2 copies/cell) in *Agrobacterium* (Zhi et al., 2015, Plant Cell Rep. 34:745-754).

TABLE 13

| SEQ ID NO: | DESCRIPTION |
|---|---|
| 134 | BBR1 ORI; *Agrobacterium tumefaciens* |
| 135 | PSA ORI; *Agrobacterium tumefaciens* |
| 136 | PSA + PARDE ORI; *Agrobacterium tumefaciens* |
| 137 | PVS1 ORI; *Agrobacterium tumefaciens* |
| 138 | repABC ORI; *Agrobacterium tumefaciens* |
| 139 | RK2 ORI; *Agrobacterium tumefaciens* |
| 140 | RK2 + PARDE ORI; *Agrobacterium tumefaciens* |
| 141 | RSF1010 ORI; *Agrobacterium tumefaciens* |

To validate this concept, a first plasmid is constructed with an ORI that results in high plasmid copy number (pVS1) and a T-DNA that contains trait gene expression cassettes such as ZS-GREEN and HRA. A second plasmid is constructed with an ORI that results in low copy number (repABC) and a T-DNA that contains a morphogenic gene expression cassette (WUS2). Both plasmids are introduced into a single *Agrobacterium*. When the plasmids residing within the same bacterial cell are co-delivered into the same plant cell, the relative ratio of delivered T-DNAs will reflect the stable ratio of these plasmids in the *Agrobacterium*.

In this manner, a similar effect is produced when compared to the method of mixing two different *Agrobacteria* containing either a trait gene expression cassette T-DNA or a morphogenic gene expression cassette T-DNA (i.e., in a 90%/10% mixture of Agro1 and Agro2). Similar to the *Agrobacterium* mixing method, delivery of plasmid mixtures from the same bacterial strain can result in a higher frequency of cells receiving both T-DNAs and permit a higher transformation frequency. When used for transformation, it is expected that a higher frequency of rapidly forming somatic embryos and resultant T0 plants containing a single copy trait gene expression cassette T-DNA with no vector (plasmid) DNA and without integration of morphogenic gene expression cassette T-DNA will be produced.

Example 21. Using a Repressor Gene Expression Cassette Outside the T-DNA to Repress Expression of a Selectable Marker Inside the T-DNA

*Agrobacterium* strain LBA4404 THY-harboring a plasmid-borne T-DNA containing a repressible/de-repressible selectable marker in addition to a cognate repressor expression gene cassette outside the T-DNA is used. For example, the *Agrobacterium* plasmid contains the following T-DNA: RB+CAMV35S PRO:TOP3::NPTII::PINII TERM+LB, where TOP3 indicates that the CAMV35S promoter has three tetracycline repressor binding sequences (operator sequences) surrounding the TATA box and overlapping the transcription start site, and UBI1ZM PRO::TETR::PINII located outside the left border. In addition to the expression cassettes described in the above configuration, a trait gene expression cassette (using the exemplary trait ZS-GREEN1) within the T-DNA, and a morphogenic gene expression cassette (using WUS2) outside the T-DNA can be added, resulting in the following *Agrobacterium* plasmid: RB+SB-UBI PRO::ZS-GREEN 1::OS-UBI TERM+CAMV35S PRO:TOP3::NPTII::PINII TERM+LB+UBI1ZM PRO::TETR::PINII+PLTP::WUS2::In2-1 TERM (abbreviated RB+ZS-GREEN+REPRESSIBLE NPTII+LB+TETR+WUS2).

This second configuration (RB+ZS-GREEN+REPRESSIBLE NPTII+LB+TETR+WUS2) is introduced by *Agrobacterium* infection into maize immature embryos from inbred HC69. In the majority of recovered transgenic events, it is expected that only the T-DNA (containing the trait gene expression cassette and the selectable marker gene expression cassette) integrates, while the TETR and WUS2 gene expression cassettes do not integrate resulting in transient expression of the TETR and WUS2 genes. Thus, WUS2-stimulated somatic embryo formation increases transformation frequency while transient TETR expression results in a temporary repression of NPTII expression. After one week in culture post infection, the transgenic cells are transferred to culture medium containing 150 mg/l G418. It is expected that forming somatic embryos containing the integrated T-DNA (with the trait gene expression cassette and the selectable marker gene expression cassette) are readily selected, and high frequencies of fertile transgenic plants are produced.

Example 22. Using a dCAS9:Repressor-Fusion Expression Cassette Outside the T-DNA to Repress Expression of a Selectable Marker Inside the T-DNA

*Agrobacterium* strain LBA4404 THY-harboring a plasmid-borne T-DNA containing a constitutive promoter driving expression of a selectable marker in addition to a dCAS9-repressor expression cassette outside the T-DNA is used. For example, the *Agrobacterium* plasmid contains the following T-DNA: RB+UBI1ZM PRO::NPTII::PINII TERM+LB, and UBI1ZM PRO::dCAS:EAR::PINII located outside the left border, where EAR indicates a sequence encoding a repressor peptide fused in-frame to dCAS9. In addition to the expression cassettes described in the above configuration, a trait gene expression cassette (using the exemplary trait ZS-GREEN1) within the T-DNA, and a morphogenic gene expression cassette (using WUS2) outside the T-DNA can be added, resulting in the following *Agrobacterium* plasmid: RB+SB-UBI PRO::ZS-GREEN1::OS-UBI TERM+CAMV35S PRO:TOP3::NPTII::PINII TERM+LB+UBI1ZM PRO::dCAS9:EAR::PINII+zmu6 pro::gRNA::ZMU6 TERM+PLTP::WUS2::In2-1 TERM (abbreviated RB+ZS-GREEN+REPRESSIBLE NPTII+LB+dCAS9:EAR+gRNA+WUS2).

The second configuration (RB+ZS-GREEN+REPRESSIBLE NPTII+LB+dCAS9:EAR+gRNA+WUS2) is introduced by *Agrobacterium* infection into maize immature embryos from inbred HC69. In the majority of recovered transgenic events, it is expected that only the T-DNA (containing the trait gene expression cassette and the selectable marker gene expression cassette) integrates, while the dCAS9:EAR and WUS2 gene expression cassettes does not integrate resulting in transient expression of the dCAS9:EAR and WUS2 genes. Thus, WUS2-stimulated somatic embryo formation increases transformation frequency while transient dCAS9:EAR expression results in a temporary repression of NPTII expression. After one week in culture post infection, the transgenic cells can be transferred to culture medium containing 150 mg/l G418. It is expected that forming somatic embryos containing the integrated T-DNA (with the trait gene expression cassette and the selectable marker gene expression cassette) are readily selected, and high frequencies of fertile transgenic plants are produced.

As used herein the singular forms "a", "an", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

All patents, publications and patent applications mentioned in the specification are indicative of the level of those skilled in the art to which this disclosure pertains. All patents, publications and patent applications are herein incorporated by reference in the entirety to the same extent as if each individual patent, publication or patent application was specifically and individually indicated to be incorporated by reference in its entirety.

Although the foregoing disclosure has been described in some detail by way of illustration and example for purposes of clarity of understanding, certain changes and modifications may be practiced within the scope of the appended claims.

---

SEQUENCE LISTING (147 sequences)

SEQ ID NO: 1 - DNA, 879 bp, Arabidopsis thaliana
atggagcctcctcagcaccaacatcaccaccatcaggccgatcaagagtccgggaacaacaacaacaacaagtccggttccggagggtacacttgcagacagacctccaccagatggacacctaccactgagcagatcaagatcctgaaggagttgtactacaacaatgccatccgctcccctactgctgatcagattcagaagatcaccgctcgcctgcgtcaattcggtaagatcgagggtaagaacgtcttctactggttccagaaccacaaggctcgtgagaggcagaagaagcgtttcaacgggactaacatgaccactccttcctcatcacccaattctgttatgatggccgccaacgaccactaccatcctttgcttcatcaccaccacggagttcctatgcaaagacccgcaaactccgtcaacgtgaagttgaaccaggaccatcacctctaccaccacaacaagccctacccctctttcaacaacgggaatctcaaccatgcctcctctggaaccgaatgtggagttgtcaacgcctccaacggctacatgtcttcccacgtgtacggctctatggagcaagattgctccatgaactacaacaacgttggaggcggatgggcaaacatggatcaccactactcctccgctccctacaacttcttcgatagggctaaacctctcttcggcttggagggacaccaagaagaagaggaatgcggaggtgatgcttacttggaacacagaaggactctccctctctttccaatgcacggtgaggaccacatcaacggaggatctggcgctatctggaagtatggacagtccgaggtcagaccatgcgcttccctggaattgagactgaactag

SEQ ID NO: 2 - protein, 292 aa, Arabidopsis thaliana
MEPPQHQHHHHQADQESGNNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQEEEECGGDAYLEHRRTLPLFPMHGEDHINGGSGAIWKYGQSEVRPCASLELRLN

SEQ ID NO: 3 - DNA, 876 bp, Lotus japonicus
atggaacaaccacctcaacaacaacaacagaatgaggatggtggtgggagtagtggtggaaaaggggggtttctgagcaggcaaagcagtacacggtggactcccaccacagaccagataagaatattgaaggagctttactacaacaatggaataagatccccgagtgcagagcagattcagaggatctctgctcggctgagacagtacggcaagattgaaggcaagaatgtcttttactggttccagaaccacaaagctagagagaggcagaagaaaaggttcacttctgaaactcatcttcttcccaatcccatacaacaacaacaaagaaatggaactaatgctgcttggaagcaacctgaagaacaacccattattaaccacaccaagtattctagtaacaacatttcagctcctgcagggatcatcacttctgctccatcttcttctgcagagattgtttctgttggccagataggaaactttggttatggatctttgcctatggaaaagagttttagggactgctcaatatctgctggaggcaacacaggctatgctggaagtgctataaaccacaacctgggatggatgggtgtggatccatattcctcagcctacaccaatttctttgacaaaataaggccaactgaagaagaaaccatggaagaagaaggacaagagaatggttcaccagagattgaaacccttcctttattcccgatgcatggtgaggacattcatagtggctatttcaacctcaagtctaattcttctcactatgctggtggctggtaccagactgaagaagggtacttcaacaatggttctcgtgcttccttggagctcagcctcaaatatcctgattttgct

SEQ ID NO: 4 - protein, 292 aa, Lotus japonicus
MEQPPQQQQQNEDGGGSSGGKGGFLSRQSSTRWTPTTDQIRILKELYYNNGIRSPSAEQIQRISARLRQYGKIEGKNVFYWFQNHKARERQKKRFTSETHLLPNPIQQQQRNGTNAAWKQPEEQPIINHTKYSSNNISAPAGIITSAPSSSAEIVSVGQIGNFGYGSLPMEKSFRDCSISAGGNTGYAGSAINHNLGWMGVDPYSSAYTNFFDKIRPTEEETMEEEGQENGSPEIETLPLFPMHGEDIHSGYFNLKSNSSHYAGGWYQTEEGYFNNGSRASLELSLKYPDFA

SEQ ID NO: 5 - DNA, 888 bp, Glycine max
atggaacctcaacaacaacaacaacaagcacaagggagccaacaacaacaacaaaacgaggatggtggcagtggaaaaggggggtttctgagcaggcaaagtagtacacggtggactccaacaaacgaccagataagaatattgaaggaactttactacaacaatggaattagatccccgagtgcagagcagattcagaggatctctgctaggctgaggcagtacggtaagattgaaggcaagaatgtcttttattggttccagaaccacaaagctcgagaaaggcagaagaaaaggttcacttctgatcataatcataataatgtccccatgcaaagacccccaactaatccttctgctgcttggaaacctgatctagctgatcccattcacaccaccaagtattgtaacatctcttctactgcagggatctcttcggcatcatcttctgttgagatggttactgtgggacagatggggaattatgggtatggttctgtgcctatggagaaaagttttagggactgctcgatatcagctgggggtagcagtggccatgttggattaataaaccacaacttggggtgggttggtgtggacccatataattcctcaacctatgccaacttctttgacaaaataaggccaagtgatcaagaaacccttgaagaagaagcagagaacattggtgctactaagattgaaaccctccctttattccctatgcacggtgaggacatccacggctattgcaacctcaagtctaattcgtataactatgatggaaacggctggtatcatactgaagaagggttcaagaatgcttctcgtgcttccttggagctcagtctcaactcctacactcgcaggtctccagattatgcttaa

SEQ ID NO: 6 - protein, 295 aa, Glycine max
MEPQQQQQQAQGSQQQQQNEDGGSGKGGFLSRQSSTRWTPTNDQIRILKELYYNNGIRSPSAEQIQRISARLRQYGKIEGKNVFYWFQNHKARERQKKRFTSDHNHNNVPMQRPPTNPSAAWKPDLADPIHTTKYCNISSTAGISSASSSVEMVTVGQMGNYGYGSVPMEKSFRDCSISAGGSSGHVGLINHNLGWVGVDPYNSSTYANFFDKIRPSDQETLEEEAENIGATKIETLPLFPMHGEDIHGYCNLKSNSYNYDGNGWYHTEEGFKNASRASLELSLNSYTRRSPDYA

SEQ ID NO: 7 - DNA, 897 bp, Camelina sativa
atggagccaccgcagcatcagcatcatcaccatcaagccgaccaagaaagcggcaataacaacaagtccggttctggtggttacacttgtcgccaaaccagcacgaggtggacaccaacgacggagcagatcaaaatgctcaaagagctttattacaatagtggaatccggtcaccaacagcagatcagatccagaagatcactgctaggctgcgacagttcggaaagatcgagggcaagaacgtcttttactggttccagaaccacaaggctcgtgagcgtcagaagaagagattcaacggcacaaccatgaccacaccgtcttcatctcccaactcggttatgatggctaatgatcattatcatcaacatctccctctacttcaccatcatcatggcgttcccatgcagagacctgcgaactccgtcaacgttaaacttaaccaagagcatcatctctatcatcagaacaagtcatatcccagcttcaataacgggaatttaaatcatgcaagctcaggtactgaatgtggtgctgttaatgcttctaatggctactcaagtagccatatctatggatctatggaacaagactgttctatgaattacaacaacgtaggtggaggatggacggcaaacatggatcataatcatcattactcatcagcaccttacaacttcttcgatagaccaaaacctccgtttggtctagacggtcatcaggaagaagaagaatgtggtggcgatgcttatctggaacatcgacgtacgcttcctctcttccctatgcatggtgaagatcacataaatggtgccagctggaagtatggccaactggacggtcatgattgtcatggtagaggcccttgcgcttctcttgagcttcgtttgaactag

SEQ ID NO: 8 - protein, 298 aa, Camelina sativa
MEPPQHQHHHHQADQESGNNNKSGSGGYTCRQTSTRWTPTTEQIKMLKELYYNSGIRSPTADQIQKITARLRQFGKIEGKNVFYWFQNHKARERQKKRFNGTTMTTPSSSPNSVMMANDHYHQHLPLLHHHHGVPMQRPANSVNVKLNQEHHLYHQNKSYPSFNNGNLNHASSGTECGAVNASNGYSSSHIYGSMEQDCSMNYNNVGGGWTANMDHNHHYSSAPYNFFDRPKPPFGLDGHQEEEECGGDAYLEHRRTLPLFPMHGEDHINGASWKYGQLDGHDCHGRGPCASLELRLN

SEQ ID NO: 9 - DNA, 897 bp, Capsella rubella
atggagccaccacagcatcagcatcatcatcatcaagccgaccaagaaagcggcaacaacaacaacaagtccggctctggtggctacacgtgtcgccaaaccagcactaggtggacaccaacgacggagcagatcagaatcctcaaggatctttactacaacagtgcgatccggtcaccaacagccgatcagatccagaagatcaccgcgaggctgagacagtacgggaagatcgaaggcaagaacgtcttttactggttccagaaccataaggctcgtgagcgtcagaagaagagattcaacggcacaaccatgaccactccatcttcatctcccaactcggttatggtggctaatgatcactatcatcctctacttcaccatcatcatggtgttcccatgcaaaggcctgctaactccgtcaacgtcaaacttaaccaagaccatcatctctatcatcagaacaagtcatatcccaccttcaacaatgggaatttaaatcatggaagctcaggtactgaatgtggtgttgttaatgcttctaatggctacatgagtagccatgtctatggatctatggaacaagactgttcaatgaactacaacaacgtaggtactggaggatacggatcaaacatggatcatagtcatcattactcatctgcaccatacaacttctttgatagatcaaagcctctctttggtctagaaggtcatcaagaagatgaagaagaatatggtataggcgatgcttatctggaacatcgacgtacgcttcctctcttccctatgcatggtgaagatcacatgaacggtagtggtgctagctggaagtttgatggccgtgattgccatggtagaggcccttgcgcttctcttgagcttcgtctgaactag

SEQ ID NO: 10 - protein, 298 aa, Capsella rubella
MEPPQHQHHHHQADQESGNNNNKSGSGGYTCRQTSTRWTPTTEQIRILKDLYYNSAIRSPTADQIQKITARLRQYGKIEGKNVFYWFQNHKARERQKKRFNGTTMTTPSSSPNSVMVANDHYHPLLHHHHGVPMQRPANSVNVKLNQDHHLYHQNKSYPTFNNGNLNHGSSGTECGVVNASNGYMSSHVYGSMEQDCSMNYNNVGTGGYGSNMDHSHHYSSAPYNFFDRSKPLFGLEGHQEDEEEYGIGDAYLEHRRTLPLFPMHGEDHMNGSGASWKFDGRDCHGRGPCASLELRLN

SEQ ID NO: 11 - DNA, 588 bp, Arabis alpina
atggctactcatgtagccattagaagcattaacagcaccacattcagaacctgaacttgcatgatttaaattcccgttattgaagctgggatatgatttgttctgatgaagcagatggtgttcttggtcatgaagcttaacgttgagagaagcaggtctctgcatggaaacaccatgatgatgttgaagaagaggatgatgatgatggttatgatgataacgatcactggccatcataactgagttgggcgatgaagacgttggtgtggtggtcatggttgtgccattgaatctcttcttctgacgctcacgagccttatggttctgaaaccagtaaaagacgtttttgccctcgatcttaccatattgtctcagccttgcagagatcttctggatctcatcagcagttggtgaccggattccactattgtagtaaagatctttgaggattctgatttgctccgtggttggagtccatctcgtgctggtttgacgacaagtgtaaccaccagaaccggacttgttgttgttgttgccgctttcttggtcggcttgatgatgatgatgatgatgttgcggtggctccat

SEQ ID NO: 12 - protein, 304 aa, Arabis alpina
MEPPQHHHHHHQADQESGNNNNKSGSGGYTCRQTSTRWTPTTEQIRILKDLYYNSGIRSPTADEIQKISARLRQYGKIEGKNVFYWFQNHKARERQKKRFNGTTMTTTPTSSSPNSVMMASDRYHHNHHHHPLLQHHHGVSMQRPASLNVKLHDQEHHLLHQNKSYPSFNNGNLNHASSGSECGAVNASNGYMSSHVYGSMEQDYSMSNNNIGGGGWSNMDHNHHYSSPAYNFFDRPKPLFGLEGHQEEDQYGGDAYLEHRRTLPLFPMHGEDHINGGGGAIWKYRQLDGLELRLNSYAGVAPE

SEQ ID NO: 13 - DNA, 873 bp, Raphanus sativus
atggagccaccgcaacattaccatcaagccgatcaagaaagcggcaacaacaacaagtccgtctctggtggttacacgtgtcgtcaaacgagcacaagatggacaccaacaaccgatcaaatcagaatactcaaagatctttactacaacaatggagtccggtcaccaacagccgaccagatccagaagatctctgcaacgctgagacagtacggaaaaatcgagggaaaaaatgtcttttactggtttcaaaaccataaggctcgtgagcgacagaagaagagattcaacagcacaaccatggccacaccaacgtcttcatcgcccaactcggttatgatgatggctagtgatcaccatcatcatcatggtgttaccatccagagacctgctttggtcaacgttaagctcgaccaagaaaatcatatgtttcaccagaacagatcatatcccagctccaataacgggagtataaatcatgcaagttcaggcacggaatatggtgttttcggcgcttctaatggctacattagtaaccatatctatggatctatggaacaagactgttcaatgagctacaacagcgtaggtggaggatggacaaacatggatcataatcatcattactcaactccagcttacaacttctttgatagaccatcgcctctgtctggactagaaggtcatcaagaagaaggacaatatggtggcgattcttatctggaacatcgacgtacacttcctctcttccctttgcacggtgaggatcacatcaacggtggtggtggttccatcttgaagtacggacaatcagacggttgtgatcgttatggtagaggcccttgtgcttctcttaagctatgtctgaactga

SEQ ID NO: 14 - protein, 290 aa, Raphanus sativus
MEPPQHYHQADQESGNNNKSVSGGYTCRQTSTRWTPTTDQIRILKDLYYNNGVRSPTADQIQKISATLRQYGKIEGKNVFYWFQNHKARERQKKRFNSTTMATPTSSSPNSVMMMASDHHHHHGVTIQRPALVNVKLDQENHMFHQNRSYPSSNNGSINHASSGTEYGVFGASNGYISNHIYGSMEQDCSMSYNSVGGGWTNMDHNHHYSTPAYNFFDRPSPLSGLEGHQEEGQYGGDSYLEHRRTLPLFPLHGEDHINGGGGSILKYGQSDGCDRYGRGPCASLKLCLN

SEQ ID NO: 15 - DNA, 885 bp, Brassica napus
atggagccagcgcaacatcaccatcaagccgaccaagaaagcggcaacaacaacaagtccgtctctggtggttacacgtgtcgtcaaacgagtacaagatggacaccaacgaccgatcaaatcagaatactcaaagatctttactacaacaacggagtccggtcaccaacagccgaccagatccagaagatctctgcaaggctgagacagtacggaaagatcgagggaaaaaatgtcttttactggtttcaaaaccataaggctcgtgagcgacagaagaagagattcaacagcacaaccatgaccataccaacgtcttcatcgcccaactcggttatgatggctagtgatcactatcaccataaccatcatcatcatggcgttaccatccagagacctgctttggtcaacgttaagctcgaccaagaaaatcatatgtttcatcagaacagatcatatcccagcttcaataacgggaatacaaatcatgcaagttcaggcacggaatatggtgttttcagtgcttctaatggctacattagtagccatatctatgaacctatggaacaagactgttcaatgagctacaacaacgtaggtggaggatggacaaacatagatcataatcaccattactcaactccagcctacaacttcttagatagaccaatgcctctgtctggactagaaggtcatcatcaagaagaaggagaatatggtggcgatgcttatctggaacatagacgcacacttcctctcttccctttgcacggtgaggatcacatcaacggcggtggtggttccatctggaagtacagacaatcggacggttgtgatcgttatggtagaggcccttgtgcttctcttaagctgtgtctgaactga

SEQ ID NO: 16 - protein, 294 aa, Brassica napus
MEPAQHHHQADQESGNNNKSVSGGYTCRQTSTRWTPTTDQIRILKDLYYNNGVRSPTADQIQKISARLRQYGKIEGKNVFYWFQNHKARERQKKRFNSTTMTIPTSSSPNSVMMASDHYHHNHHHHGVTIQRPALVNVKLDQENHMFHQNRSYPSFNNGNTNHASSGTEYGVFSASNGYISSHIYEPMEQDCSMSYNNVGGGWTNIDHNHHYSTPAYNFLDRPMPLSGLEGHHQEEGEYGGDAYLEHRRTLPLFPLHGEDHINGGGGSIWKYRQSDGCDRYGRGPCASLKLCLN

SEQ ID NO: 17 - DNA, 885 bp, Brassica oleracea
atggagccagcgcaacatcaccatcaagccgaccaagaaagcggcaacaacaacaagtccgtctctggtggttacacgtgtcgtcaaacgagtacaagatggacaccaacgaccgatcaaatcagaatactcaaagatctttactacaacaacggagtccggtcaccaacagccgaccagatccagaagatctctgcaaggctgagacagtacggaaagatcgagggaaaaaatgtcttttactggtttcaaaaccataaggctcgtgagcgacagaagaagagattcaacagcacaaccatgaccataccaacgtcttcatcgcccaactcggttatgatggctagtgatcactatcaccataaccatcatcatcatggcgttaccatccagagacctgctttggtcaacgttaagctcgaccaagaaaatcatatgtttcatcagaacagatcatatcccagcttcaataacgggaatataaatcatgcaagttcaggcacggaatatggtgttttcagtgcttctaatggctacattagtagccatatctatggacctatggaacaagactgttcaatgagctacaacaacgtaggtggaggatggacaaatatagatcataatcaccattactcaactccagcctacaacttcttagatagaccaatgcctctgtctggactagaaggtcatcatcaagaagaaggagaatatggtggcgatgcttatctggaacatagacgcacacttcctctcttccctttgcacggtgaggatcacatcaacggcggtggtggttccatctggaagtacagacaatcggacggttgtgatcgttatggtagaggcccttgtgcttctcttaagctgtgtctgaactga

SEQ ID NO: 18 - protein, 294 aa, Brassica oleracea
MEPAQHHHQADQESGNNNKSVSGGYTCRQTSTRWTPTTDQIRILKDLYYNNGVRSPTADQIQKISARLRQYGKIEGKNVFYWFQNHKARERQKKRFNSTTMTIPTSSSPNSVMMASDHYHHNHHHHGVTIQRPALVNVKLDQENHMFHQNRSYPSFNNGNINHASSGTEYGVFSASNGYISSHIYGPMEQDCSMSYNNVGGGWTNIDHNHHYSTPAYNFLDRPMPLSGLEGHHQEEGEYGGDAYLEHRRTLPLFPLHGEDHINGGGGSIWKYRQSDGCDRYGRGPCASLKLCLN

SEQ ID NO: 19 - DNA, 882 bp, Helianthus annuus
atggaaactcaacaacaacaagcagatattcaagattttgggaacaaaaacagtaacacctatgcatgcaggcaaagcagtactaggtggacacccacaagtgatcagatcagaatactgaaagagctctactacaacaatggaatcagatcaccaactgctgatcagattcagagaatcgctgctcaactcagacagtacggcaagattgaaggcaagaacgtgttttattggtttcagaaccataaagctcgtgaacgccagaagaaacggttcactcctactgctcctccaccaccgtctcacttctccgatcatattaaccaccatcttcccaacgctgcccccatgcagattccgtctcaccaccaccactaccaccatcaagaaccaccacatgtctatgctcaccctcacaaactctacaccactcatcacattggggttggttcttcttcacaaggagtgatgggtgtagggtgtggctatggatctgttgctatggagaagagtttcaggaagtgttcaatatcaccaccgggagagagtaaggccacaggaggaattggccggaatatcggttcaagatcacggataagtgtcgattcgtgttccttcttcgacacaattaagccaaagacatatgagatgtttgagaatcatgatcaagatgaagaacaaggagagccttcaactgagatcgaaacacttccattattcccgattcacgacggcaaccatcatgatttcttcggcatgaggacggcaaatctgcaattggagcaaggcactggaggttactacactggaggaagctggtatcggtctgatgagagggcgtctcttgagctcagtctcaactcatatggttattataactaa

SEQ ID NO: 20 - protein, 298 aa, Helianthus annuus
METQQQQADIQDFGNKNSNTYACRQSSTRWTPTSDQIRILKELYYNNGIRSPTADQIQRIAAQLRQYGKIEGKNVFYWFQNHKARERQKKRFTPTAPPPPSHFSDHINHHLPNAAPMQIPSHHHHYHHQEPPHVYAHPHKLYTTHHIGTHNIRVGSSSQGVMGVGCGYGSVAMEKSFRKCSISPPGESKATGGIGRNIGSRSRISVDSCSFFDTIKPKTYEMFENRDQDEEQGEPSTEIETLPLFPIHDGNHHDFFGMRTANLPLEQGTGGYYTGGSWYRSDERASLELSLNSYGYYN

SEQ ID NO: 21 - DNA, 795 bp, Populus trichocarpa
atggaacctcaccaacaacaaccaaatgaggataataacggtggcgccaaagggaactttctttgcaggcaaaccagtacaaggtggaatcccactactgaccagataagaatattgaaggaactgtactacatcaaaggtgttaggtccccaaatggagctgagattcagcagatctctgctaggcttagaaagtacggcaagattgaaggcaagaatgtattttattggtttcagaaccataaagctcgtgagaggcaaaagaaaagactcaccaatgaagtccccatgcaacaaagaactgcctggaaacctgaagattattactcttacaagtactccaacagtaataataatcctgggttttcttcggcttcttcatctgcaaataccggtgtggttactgttgggcagacagatagccatggatatggatcggtaaccatgcaggagaagaattcttgggactgttcagcaccagctggtggtagcaatggtgctggtagtggatccatgagcaatattaactatggatcaggggttgacattaactctcacagttcatcctatgctgtatttggtcaagaacaagaagcagctgcaaagattgagactcttcctctatttccaatgcttggtgaggacatcagtagctctttcaacatcaacaatatcaacccagacttttattacagtagcggctgtggctatggtgattatggcaatgacacttcttcccgtacttccctggaccttagtctctactcctacaatggccaaccacaagattattaa

SEQ ID NO: 22 - protein, 264 aa, Populus trichocarpa
MEPHQQQPNEDNNGGAKGNFLCRQTSTRWNPTTDQIRILKELYYIKGVRSPNGAEIQQISARLRKYGKIEGKNVFYWFQNHKARERQKKRLTNEVPMQQRTAWKPEDYYSYKYSNSNNNPGFSSASSSANTGVVTVGQTDSHGYGSVTMQEKNSWDCSAPAGGSNGAGSGSMSNINYGSGVDINSHSSSYAVFGQEQEAAAKIETLPLFPMLGEDISSSFNINNINPDFYYSSGCGYGDYGNDTSSRTSLDLSLYSYNGQPQDY

SEQ ID NO: 23 - DNA, 843 bp, Vitus vinifera
atggaacctcaacaacagctccagcagcagcagcaacaaaaccaacaacagccaaacgaggatagcggcagcagcaaaggcagttttctgtgcaggcaaagcagtacacgctggactcctacaactgaccagataagaatattgaaggacctttactacaacaatggagttaggtccccaagtgctgaacagattcagaggatctcagctaggctgaggcagtacggcaagatcgaaggcaagaacgtcttttattggtttcagaaccataaagctcgtgaaaggcagaagaagcgattcactactgatatgcccatgcaaagatcccttggaaatgccggttggagacctgatgatcccattcacaacaaatttcataccattcccactcctgggatatcttccccatcttcttcttcttcacccagtgtgcttgctgttgggcagatgggaagctttggatatggatctgtggagaggagttttacagactgttcaatatcagcaggtggtggtcgtggtggggttggtggatctataaaccagagcttcgaatgggttggcatggacccatattcttcatcttatgcactctttgacaagagaaaaacaatgggtgaaagcttcgaagaagagcaagaagaagaagcaactccggagattgaaacgctcccactctttcccatgcacgctgaggatatcactggcttttgcaacattaagcccgaatccgacgcctactactccggctggtacaggcccgccgacgccaagaccagttcccgcacttctcttgagcttagcctcaactcctacgccggcaggtccccggattccccctga

SEQ ID NO: 24 - protein, 280 aa, Vitus vinifera
MEPQQQLQQQQQQNQQQPNEDSGSSKGSFLCRQSSTRWTPTTDQIRILKDLYYNNGVRSPSAEQIQRISARLRQYGKIEGKNVFYWFQNHKARERQKKRFTTDMPMQRSLGNAGWRPDDPIHNKFHTIPTPGISSPSSSSSPSVLAVGQMGSFGYGSVERSFTDCSISAGGGRGGVGGSINQSFEWVGMDPYSSSYALFDKRKTMGESFEEEQEEEATPEIETLPLFPMHAEDITGFCNIKPESDAYYSGWYRPADAKTSSRTSLELSLNSYAGRSPDSP

SEQ ID NO: 25 - DNA, 879 bp, Arabidopsis thaliana; identical to SEQ ID NO: 1

SEQ ID NO: 26 - protein, 292 aa, Arabidopsis thaliana; identical to SEQ ID NO: 2

SEQ ID NO: 27 - DNA, 879 bp, Lotus japonicus
atggaacaacctccccaacagcagcaacaaaacgaagacggaggcggatcaagtgggggaaaaggagggttcctcagtaggcagtccagtactaggtggacacccaccacagaccagattcgcatcctcaaggagctctactacaacaacggaatacgctcaccctccgcagaacagatccagaggatctccgcaagactcagacagtacggcaagatcgagggcaagaacgtcttctactggttccaaaaccacaaagcccgcgaaaggcagaagaagcgcttcaccagtgagacacacttgctgcccaacccaattcagcagcaacagcgcaacggaacaaacgcagcttggaagcagccagaggagcaacccatcatcaaccacaccaagtactcctccaacaacatatccgcacccgcagggattatcacaagtgccccatcttcttccgcagaaatagtctccgtggggcagatcggaaacttcggatacggatctctgccaatggagaagtccttcagggactgcagtatctcagccggaggtaacacaggatacgccgggtctgctattaaccacaacctcggatggatgggagtcgacccatactcctctgcttacaccaacttcttcgacaaaatacgcccaacagaggaggagactatggaggaagaaggacaggagaacggctcaccagaaatcgagaccctgcctttgttcccaatgcacggagaggacatccactccggctacttcaacctcaagagtaactcatcccactacgctggcggatggtaccaaactgaggaaggctacttcaacaacggatcacgcgccagtctggagctgtccctgaagtaccctgacttcgcttag

SEQ ID NO: 28 - protein, 292 aa, Lotus japonicus; identical to SEQ ID NO: 4

SEQ ID NO: 29 - DNA, 909 bp, Medicago trunculata
atggaacaacctcagcagcagcagcaaccacagacccaacagcactctccaaacaacggaatcatggggtccagacagagttccaccagatggaccccaacaaccgaccagatccgcattctcaaagacctctactacaacaacggaataaggtctccaagtgccgagcaaatccagaggatctccgcaaggctcagacagtacgggaagatcgagggcaagaacgtcttctactggttccaaaaccacaaagccagagagcgccagaaaaagcgcttcacctccgacgtcaacgtcgtccctatcatccagcgcgcccccaacaacaatactatcataagtgccgccaactggaagcctgaccaccacgaacaacagcagaacattaatgtccacacaaaccactccacatacaacatctcctccgctggcctcagttctgcttcctgctcctcagcagaaatggtcactgtggggcaaataggcaactacggctacgggtctgtcccaatggagaagtctttccgcgaatgcaccatctcagctggatgctcatcatcccaggttggctcaaccataaacccccacatcggctggatcggacaccacgtcgacccatattcaagtgcctacgctaacctcttcgagaaaatacgccccaacgaggagatcatggaagagtacgaccagggacaggaaaacggttccccagagatcgagacactcccactcttccctatgcacggagaagacatccacggagggtattgcaacctcaaatcaaattcctccaactacggaggatggtaccaggcagaagacgcagggttcatgtacggaagtcgtaccacttctctcgagctcagtctgaactcctacggatgcaggtcccccgactacgccaattaa

SEQ ID NO: 30 - protein, 302 aa, Medicago trunculata
MEQPQQQQQPQTQQHSPNNGIMGSRQSSTRWTPTTDQIRILKDLYYNNGIRSPSAEQIQRISARLRQYGKIEGKNVFYWFQNHKARERQKKRFTSDVNVVPIIQRAPNNNTIISAANWKPDHHEQQQNINVHTNHSTYNISSAGLSSASCSSAEMVTVGQIGNYGYGSVPMEKSFRECTISAGCSSSQVGSTINPHIGWIGHHVDPYSSAYANLFEKIRPNEEIMEEYDQGQENGSPEIETLPLFPMHGEDIHGGYCNLKSNSSNYGGWYQAEDAGFMYGSRTTSLELSLNSYGCRSPDYAN

SEQ ID NO: 31 - DNA, 924 bp, Petunia hybrida
atggaaacagcacagcaccagcagaacaaccaacagcactacctccaccaacacctctccatcggacaaggaacaaacatcgaggacggcagtaacaagaacaactcctccaacttcatgtgcaggcaaaatagtacccgctggacaccaaccactgaccagatcaggatattaaaggacctctactacaacaacggagtcagatcacctaccgctgaacagatccagagaatctccgccaagctcaggcagtacggcaagatcgagggcaagaacgtcttctactggttccagaaccataaagcccgcgagagacaaaagaagcgcctcatcgccgcagccaccaccgataacactaacctcccaatgcagatgcagttccagagaggagtctggagatcctctgcagacgaccccatccaccacaagtatactaatccaggagtgcactgcccttcagcttcttcccacggagttctcgcagtcggacagaacggcaatcacggatacggagccttggcaatggaaaaatccttccgcgactgctccatcagtccaggcagttccatgtcacaccaccaccaccaaaacttcgcttgggcaggagtcgatccttattcctcaaccacaacctaccctttcctcgagaagaccaagcacttcgagaatgaaaccctcgaagctgatgaagagcagcaagaggaggaccaggagaactactactaccaaaggaccacctctgccatcgaaaccctgcctctcttccctatgcacgaggagaacatctcctccttctgcaacctcaagcaccaggagtcatccggaggattctacaccgagtggtacagagcagacgacaacctcgcagcagccagagcttccctcgagctctccttgaactccttcatcggcaactcctcctag

SEQ ID NO: 32 - protein, 307 aa, Petunia hybrida
METAQHQQNNQQHYLHQHLSIGQGTNIEDGSNKNNSSNFMCRQNSTRWTPTTDQIRILKDLYYNNGVRSPTAEQIQRISAKLRQYGKIEGKNVFYWFQNHKARERQKKRLIAAATTDNTNLPMQMQFQRGVWRSSADDPIHHKYTNPGVHCPSASSHGVLAVGQNGNHGYGALAMEKSFRDCSISPGSSMSHHHHQNFAWAGVDPYSSTTTYPFLEKTKHFENETLEADEEQQEEDQENYYYQRTTSAIETLPLFPMHEENISSFCNLKHQESSGGFYTEWYRADDNLAAARASLELSLNSFIGNSS

SEQ ID NO: 33 - DNA, 864 bp, Phaseolus vulgaris
atggaaccacagcagccccagggcagtcaaccaaacgaggacggtggaagtgggaaaggcggatttctctccagacagtcctccactaggtggactccaaccactgaccagatcagaatactcaaagacctctactacaacaacggaatcagatccccttccgcagaacagatccaaaggatctccgctaggctcagacagtacgggaagatcgagggcaagaacgtcttctactggttccaaaaccacaaggccagggagagacagaagaagaggttcacctccgacaacgtccccatgcaaagacctgcaccaacaaatgctgcacctccttggaaacccgaccaagaccccattcacaccaagtactccaacatctcctccacaggaatctccagtgcatcctcctcctcagtcgagatgatcaccgtcggacaaatggggaactacgggtacggaagtgtgccaatggaaaagtccttcagagactgctccatatccgccggaggatcttccggtcatgttggaataaaccacaacctcggctgggtgggagtcgatccttactcttctgcatacgccaacttcttcgataaaataagaccaaacgaagagaccctcgaggaagaagaagaggaggaggaggaggaagaagaagaggacggaggagcagaaattgagaccctccccctgttcccaatgcacggagaggacattcacggctactgcaacctcaagtccaacagttacaactacgacggcaacggctggtatcacagtgaggatggcttcaaaaacggcagtagggcctccctcgagctctccctcaactcttacaccagaagatcccccgacttcgcatag

SEQ ID NO: 34 - protein, 287 aa, Phaseolus vulgaris
MEPQQPQGSQPNEDGGSGKGGFLSRQSSTRWTPTTDQIRILKDLYYNNGIRSPSAEQIQRISARLRQYGKIEGKNVFYWFQNHKARERQKKRFTSDNVPMQRPAPTNAAPPWKPDQDPIHTKYSNISSTGISSASSSSVEMITVGQMGNYGYGSVPMEKSFRDCSISAGGSSGHVGINHNLGWVGVDPYSSAYANFFDKIRPNEETLEEEEEEEEEEEEEDGGAEIETLPLFPMHGEDIHGYCNLKSNSYNYDGNGWYHSEDGFKNGSRASLELSLNSYTRRSPDFA

SEQ ID NO: 35 - DNA, 3200 bp, Glycine max
agttttttagtagtattttaacgttttttgaaacacctaacattcttttaagatattaccttctgaattctaattttttatattttctttcaattttattattaatatatttatttattttctttgttatcttttcttaaaataaattatgattttattattttttttatcattttatatttttcacctacttcaacaaactaattttttagtttccggtttaccaactagcttgcctacttctagctagtttttttactagttttgacaaaactaactaaagtcaaaaagttaattagtagttgaatgttgaaaatatatcttattaaatcataaaatggttgataaaattatttattaaagtaactgaacaatataaaattacatggacatatttttatacaacttttaatttgacttttttctataaaaagaactataatatttataatgttagtattaaattaattttaaacatttgtagctttttatttatgaaatataaaaaaatctacataaacttattatatatcaccatcaatatcatatataataaaatggtaaaaatgagaaaattctatcatatgtaaaaaagttaatttttttttcttaaataaaaaagattaaaaaggaaaacttataaatgttaaagaacaaaaaagaataaatacaaaaagttataaaaactagtgttttaaaaaatataacttaaaatttttaataacttctaacattttttaaaacgttacttaaggtaacactttttaatatatcaacttctattttattatatatcactatcaatatcatatataataaaatggtaaaaatgagaaaactctattatatataaaaagttaaaaataatgaattttttccttatataaaatagattaaaaaaaattctaataaatattcaacaacaataacataataaatataaaaagttacaaaaaaaaactaacatttttaaaaatataactttagtgtttcaaaaatccttagagttgttaaataaaaacttatttaccaaatttttaaactagtaaaaaaattaaaaactaattaaaatatcttgttaaatatattttaaatagtgtataatttatcatgtaagataatattcttatttttataataattactttaaaaatcatatctaaaagatttttaatatgtaatattatatatatatatatatatatatatatatatatatatatattcataaaacatcattaaaagtgacattaaaaacatattaaaaatcacattaaagcacattaataacatttaatttcaatactaagaactctttcaattcttgaaccaattacacttgtcttaatgggggaaaaaaaaacaaactctatacttatccgatcggaaaaactgcaaaagagaagaagaaatgaatgggagtgacacgcacaaattaatttcaagataccagcacttagtagcaatttagtagcatttgtttggtagccgtcattcgttgcattgcaccgtcaactcgcaaaaaatttattagtagttttatacaccaaaaatatgctgcgtctctttctctctcccctctctatcaattacacctcttttgccctccattaaatgcaattgcaccctctcaatacgctctgcaattactcttcgctgccacattttcctccatttgttccccacttccctctcctccttcaatgcccttgtccctatctcttcttcttctcctcactttctctctgtaacacctcttcatgccatagcttctttttcttttcttttttaccatataagtaaacattttttttttcaaaactgtcccaaacccttccttcaaaacggtcatctcttttcaacccaaaacagatctacaccttcatcttctactcccactctcactggtaagttaaaaaaaatcttgtttgtaaaacttctgtcgcaaccagggtcactgcgtgaatctctgtaacattcatgttttttttgttaaggttgtctaaggtcattgtttttttttaaagaaaaaaaaaagaaactaactaatgaaactgtttggtacaatttttttttttttttttgtgagttctaacatttttcaggtgagtcacttgtagctagggctgtgagaaaaggaacgttattaggtctgcaagaaaaaaaaagaaaaatatcctgatatataggatatgcgttgtaggattttctccgagatcttcgtgggtgttatattttctttaaaaaagttttgattttgttttgcgaaaagacaagatcagataagggttacaatatttctttgctttttaattcatatattttgatatgatatatgcatagcgtatatttgtttcgaaattttgattaagtttttttctctttaatcttttttttctcttggaggtcacgtttgtatcactgagtttttttgtagtaacacacacacttactcgctttgacattgctatctgacagaaaatccaagggctcaacttcttaagctttttctctatccaagaacctcttaggagagagaaagtgatatatatagagagagaaagagtcaattctacatatacttgttggtggtggtttttgaggcatgtgaagtatgcaagccgttattatgatgattccggcgagaaacatgccttcgatgatagcaaggaacaacaacaacgttggagggttttttggatcatcttcatcacctttcactcttgcccaggtcggtgcttttaacttttcaccttctctttcaactcttttgactctcttaccttctcttttttttttttttcacaattgtccacctctttaatttttcacccttttttcattaaaatttttgaaacaaaattgacccatctcaaaattttcacttttttaacgatcagtcgatcacatttgcatcacaaattaaaccaaccagaccaaatatccttctcgatattacaaatccgcgtttccccaaaactgcgttatttttctccataaaaaagtcaaaagaaaaaaaaaattaaactttctttaaaaaaaacaagaaagaaagaaaagaaaatgttgatatgtttgttgtgtctttttctctgagagagaaccgtactatactacatgtgtttgaattgtgtttttgttagattgagaaactataatcctctctccggaaccttaaaagatccgtagcaataatcata

SEQ ID NO: 36 - DNA, 1547 bp, Glycine max
agttttttagtagtattttaacgttttttgaaacacctaacattcttttaagatattaccttctgaattctaattttttatattttctttcaattttattattaatatatttatttattttctttgttatcttttcttaaaataaattatgattttattattttttttatcattttatatttttcacctacttcaacaaactaattttttagtttccggtttaccaactagcttgcctacttctagctagtttttttactagttttgacaaaactaactaaagtcaaaaagttaattagtagttgaatgttgaaaatatatcttattaaatcataaaatggttgataaaattatttattaaagtaactgaacaatataaaattacatggacatatttttatacaacttttaatttgacttttttctataaaaagaactataatatttataatgttagtattaaattaattttaaacatttgtagctttttatttatgaaatataaaaaaatctacataaacttattatatatcaccatcaatatcatatataataaaatggtaaaaatgagaaaattctatcatatgtaaaaaagttaatttttttttcttaaataaaaaagattaaaaaggaaaacttataaatgttaaagaacaaaaaagaataaatacaaaaagttataaaaactagtgttttaaaaaatataacttaaaatttttaataacttctaacattttttaaaacgttacttaaggtaacactttttaatatatcaacttctattttattatatatcactatcaatatcatatataataaaatggtaaaaatgagaaaactctattatatataaaaagttaaaaataatgaattttttccttatataaaatagattaaaaaaaattctaataaatattcaacaacaataacataataaatataaaaagttacaaaaaaaaactaacatttttaaaaatataactttagtgtttcaaaaatccttagagttgttaaataaaaacttatttaccaaatttttaaactagtaaaaaaattaaaaactaattaaaatatcttgttaaatatattttaaatagtgtataatttatcatgtaagataatattcttatttttataataattactttaaaaatcatatctaaaagatttttaatatgtaatattatatatatatatatatatatatatatatatatatatatattcataaaacatcattaaaagtgacattaaaaacatattaaaaatcacattaaagcacattaataacatttaatttcaatactaagaactctttcaattcttgaaccaattacacttgtcttaatgggggaaaaaaaaacaaactctatacttatccgatcggaaaaactgcaaaagagaagaagaaatgaatgggagtgacacgcacaaattaatttcaagataccagcacttagtagcaatttagtagcatttgtttggtagccattgagaaactataatcctctctccggaaccttaaaagatccgtagcaataatcata

SEQ ID NO: 37 - DNA, 3300 bp, Arabidopsis thaliana
taacaatgataagctacattgagtgtatcagttctaaaactttatagtatgctacaatcaatttttctaagtaacaacttcaagcaaggaatcacacacacacagtggtacataataaacttgattttaatatcatatgatcagcatcattaacggaataagttaagtaattcgtcatccatactactaagtcatattaaaatcataatcaaacttaaaagccgattagaaagagagcaaatatatctaaaaattcacgaggaagacgacaaatgcaaggaaacacagctagtattattaaacttaatagatattggatgaatgactgcataatatatatcacattaaaagtggacataaatttgcatatgtgtaatgtacctctccacaattaatcgcggaccatttattttactattacaagtcaagtaactttatattgttgatccataattcttttcgaacataaaatcatatacttaggccattttcaactgtcaaaactcgaatccgagaaccaaatttcaccattttccaaaaatgatgagtgtcgaccaaatggggtactactgtctaatcaggaacttgtgaacaaattttcaaccttttccaaataagacgagtgtcaaccaactttttccaaccaagagatattgggttgctacacaaatacttaatagccattgcatatttatgcatatgcaaatgcagggtcgtggcgtcagaaagaaacataggaccctcaacatatttaatattttgggagctatatttgactatttcatattagaaaataataataaaaaagtgttggttttatatcaaattgtaatttacgaaaaacttatgcttttgcgcaatgatttttgtaaagtatctactatgtttagtgtttacattgattagtaggctgccgttttttttcttgtgtattatgtactatatatgaatatgaacatttgtaaaagtgaatcttgtcattttcttgttgaaaacatatatagtatgtgcaaacaaagcataggttaatccaataccacacaaataacacgtcaggtaaatccaataataaatcgtatgtgcatgtatgtgtattcatgtatgttacatgaatgtctgaatcagtcagtgtacgtatatgatgtaggtgatgtaaatcttaatgtatgagctgtttcttggaccatggtccacaatggatattgctccccaactacattagtcaatcgactggccaatttttaattaagataattaatccaaactaccattaaatataactttgaccttttttctattcatttttagatattattggaacttacgtagtttacatgcatctcatccctttcttttgctccttgaaagtgggtccaatcacaaaaaatgatcttatattttgtattttgtattttaaaaactcataattatataggttcaaaaatttaattaacatcagtgtatactataattactactctagccaacaagataaattcattttgacatcagccaaaagataaaaatttggttaaaaactattggattagcttttagtatttaatattttatgtactgattaaatacgaatttagaaatctaggatataagtgagggtgtataataagggaggggtggaccattaatagcgatgtgcaattaaaaattatgattaagaatctaggaaatttgtagattgcttagttatttttatggcgatcgtcgtgtcaatgtcatggattttgaaactttaaattaatctcttaaattagcacctacctttgaattttatagaatctttttattttatatgtttaattttatagaatctaactagcttattttgagattaaattgtttagttacttttataacagtataaatgtataatgaggacctaagaatgtagtcctgtaatgttcttgctattctacttaatctcatcaccaatcaaccatcaaaagaagctagtactaataaaacctgcaggtattcgaataataattaagctcaaacactatactaatttatggaggattatatattcaatgaattaggaacctcatgatggacattattgactgatataatgtgtatactaattgtgagtatttaaaaaccatacaaagcatttatatgtccacatatattggacacacatgcaatcaatgttcaatatgctccacacacagaaataaaaatactctttctgatcatatgatacatcatacatatactaaaaaaatctaaaatgaactataaccacaagcatatataataacaatgaaatggtaatgtttcttcatttttatttgttcaaattcttattcggttgttttttcttaccctacgagaatccgtgaggtcaaagggaaacagtgattttttttttgtattttgttttttaaattgatgaactgtaaaactctctctctagaaaaatatataagtagtagtatgaattttctctcactaaaagcattaatggacctttcgataatcataaatgcaatgcaccctctctatgcatttcgcaataactccttttccttctgccacatcctcttcctcacctctttctcttcttccctttctcctaagttcctcctccaccaaattctccatttatttcgttaactatcctccatttgttttcttctgaagagtgatatattctacctttctctggttaaagaaactccctgaatccaccggttatgtcttgaccggctataagcctataaactgatgccctaagacacctttttaggtttctcaataattctccgcatctatcttttcttctccacaagtaagagaaccagaaaaccagagaagaagccgagctagctagggtttcattgtgtgcacaaaagtaagatctctctctctaaccaatacttgtgtaatttgtctttgtttctttgagcaaatattgcatgtttgttcatattagccggatccgttttatattttttcatgatctacattttatctttattttgtttgtaaattaatgagttttttttttttttttctgtttttgtcacgatctaaaaaacaagcgttacaaagaagaagaaaaacctttttggagttagaagtgtaaaaggggtttcagtttgacgaattttccttagtagttgtgtaaaaaaaggccattgacttaatgtcaactctatatatctacacatttttttattaattagtttttgtttttttcccacttcatttacctttagtcaatgaatttttactgaaaacgttttttcaaggtcaatttcactgagttaaaaaaaa

SEQ ID NO: 38 - DNA, 6022 bp, Glycine max
tcgttgaaaacagaaaatggtgatgagaatgtatttggttggatttttgaaaacattttcagtgaaaatgaaaacagaaaataaccagaaaatgaaaataataaaatttcgttttcagcgttttcaattgaaaacaagaacctcattttggataaaatgaaaatgagatgaaaataaatgtaattttaagcaaatttaaaaatacaaaaaaagtcaatatatcataaattttcaatatttttatttcctaaaaacagaaagcaaaaagttaaaccaaacatatttttagaattctaatctttagaaaataaaaacaattttcaaaaaatgaaaataaaaaataaaaatataaaccaaacacacaatatttcagcttgtgagtgcaaaacatatgcacgtttttcatttaagtatttctacagataactagacgaattgaaagttgttataaattttacttcaacaaccaccttaaaagggacctccgcatgatgatgaacgccactagttagaccatctctaatctctctgcattcttgcatgataagagaataatgaataattctaacataaaattagcttacgacattttcgcctctattactaatttgctagtattttatctttatctacctagcttgcattctgcatatgaaatttgtggcatgtaattttattaatgctatttaaaccaatgaatatattgaagctgcttctatgaattttactttttaacctaacatcaaattaatgacaaagaaaaggttcaaaaaattattttgaagcactactcgatcagaaaatggttcaatgaaatataaatgcatagctacagtggtgaactaagatctataatctctatatatccttatatattctttcattgatattcctcttaaaagtacatccaattgattgaagccttatctttacatgtataataaataataaaaaattagagcaataaacatatttacagattaactgacttaattaaagacaataaatatactaaacaaaaagaataagactataagagcatgtctcattattattaaaggtaattttgaaaataatatataaatttaggataaattatatatataaaaaggaacaaaaggcagcggttgattattaaattagttaatttgttgatgacttgtaaatcatgagaaactaaagaaaaataaaaaaacacctcaaacttccaccaaatcaccatatccaccgacagccaaatcaagtcataaaatgtcgatgaacctccccatctaccttgatcatgagtttgggattcaattgtagtgcattgacacctcgctttcaaagcaccctccagcctaatttgtagagccagtcaaacttgattctctacttttacctttatttaaaaaatcgtgcttaatatataatgcaagtttatagtatacccattccctttcttcacaaaaaaaaaaaatgaggaaatagaacattaagtactaggaatagacagagaagtctttcttaagttgggactgggatctcccgatctggtgggcggtactgtagcttaataaatctgactggggctattaggtggtgttttgtttgggagtttatttttttattttttatttttaaatttttaagatttataagatatgtatcaataataaattactttaagtttaagatatcatgatattttttgtttttcagaaaaggctaaaaatattgattttttgttttcagttttggatctatttttaaaagaaaatatttttaaaattttaaaaaaatacatttttattcttattttttttatttgaaaataaaaacaaaaaaacactcaaatcacgcatcattctagattttgagtgtctttttttctcaatgacaagagactattaatattttttagttcacttggtcataaactaattccactattagattttgagtgtgtgttaataaaaaatatttattaatcaacaatttttttatcaacaaatattaattttattaatagagagaatcaaattcacaattttttttaatcattcaacccacctcatatctcccaaatctatcaccagattaaatctttctaccatataagaatcaaatttaaataaacacaattattatttagtgactaattttgtcttctaaaattagtatataagaaaatttcatatttaacagctccaataagtctcactatgattatataccaaaattaaactcttagaagaattgttactgaaatcattaatatatatttttatggagaaaccattaaatttcaaaagagtctttctattataaattataatttataaatatgcttaatcaatatttcgcactaataaataatagaatgtttgcttataattaatttaatttgcgacgctagggttgagaaatacaggagttaaaagaagttgttgagttcagtggacctaggtcacaaaataaaagttaaattaagcatgaatgatatcgcgctctaactctcttctgttcacgtatatccatttacaccagtcgtccctccataaatgcttctacaccctctgcaataactccatgctgccaaaccttctctcacttgttctatttatctcctcctgcgttgtttcgttctgtctctattttgctttggcccaaactaaaactccatcaactactccttcacttccctaattccccccacacccattcttgtttctaccgttccagtcatcatcaacataactaattaaggtttacaccactatcaaacgcttaaggtcccctctcgcatatacgcgtgtttaattttagctttgacttgctttgctttgcttagcttagttaatttctgagtgagagaaaggggtaacggctacgtcccccgcattgaaattggttacttgactagcgtaatcatctgttttgtcaaacctttcacactctctacccttattttgtcttttctgatttccctagcttttgtcttttggggtggcaagttttgcgtgtaagataagagtattaaggccaaccaaggccaggtaaagtcaccagtgcctctttgcaaccttaacataagaatgaatctccaaacaaacacttgaaagtgctgcatatcgatcagagacaaaacagcggcacgagctggtcgatgcttttatcagtttcagctttgcgagacggttccataaatcccaattgcaagtaccatcaaactttacagagggaaagcggtcgattcattgctgtcatcttcgtggttaatctaacaggtgatcacttccctaatttcttattttctctcctaattaaacagagatagaacaccttttcttttttgagttgaacagcaatttgactaaatggtaaaacttgtacattttctttattctcgatggggagatctggcttagaaattttttacatatagaactccgattattaatcgttgttgttgttatcaaatttgttcaatttaatgctttattgccaacaaattaagtttagtctttttgagtaatgtgagtacttttctaagcatctaataataagctattgaagctcaatttgcctaaagcaccaaacttaatgctttattattttttgttttataggatacttttacttactttataagaattacaaaataaaatttagttagtgattttatatttgtgaaacttttatattttttaaatattctgtaaattattaaaactctattatcttattacagtatttgtttttatgataaggaagtggaaggaaaatgaaaagaaactatattatttttttaatgtttatttgagtgggaaaaaaagtttcaattctaaggcccatgagaaaatataattccttccctcccaaatttggcatgaaagggttgaggggaaaaatgatctcttactcatttttatttttgtttttttaatatatatatatatatatatatatatataacatgattttttatataaaaaataaatgatttcaccttatgaaaaatagttaaatataaaaagtttgtcttttaaagttaattgtattttttttaattagaatgataaatataactttttttgtaaggcctgtggctctttcgtgcttccataagcatcactatgagactaacttaaacagttagcccttttcccctttccccctttttcaaatatgcaaaccgaactcgtctatttattttcacttatctaaataattacaggaaaaattctctacgtttttcttatttccatatatcaaaataatacattttttctattcttttaatattttgttttttatctttcttatttttttctctattttatttctaattcaaatagaacattaatttgtttctatcgaatctttgttacccataataaactgtgtgtagtgtatacttgtaggttttttttttttaaaaaaaaatccttctgtctgctcaattaacaaataattctaaatcatttaatattctcttactaattttcctacattctttatatgtaaatgttctatatcttcaaacaaaatatcccggtatacattaactaataaccgaatactctctctccgtcttaagtatcgatctagattaatttatccagataaaaaaaaagttaatacacgtatgaaaaaataataattttacaaaattaaatttattaaataaattaaaaaaagtactattggtattacattaaaaaactaaagtgaaacttactaaaagagaataattttaaatttgacttctggatatataattgtattaaatagttgtatacataatttctatccttgtacaaaattgtctataataaaaaaattcatgtgatttataccaattttttcccatacccatatatattaatcttgtaaaatgtttaggatatataattaatatttttaactagaactagaatttgaatttttacttaagtaaaaaaaaaactcattttagaattaaaatcacaattattatagcataactaaaatcaacccttcccaattatattttggaaccaattgaccttaatctcaattcaatttgtaaaaaaaaaaagcgtattaaatagaaaaaaatacattaatattttaaaatataagcaatatatttaatacatttttcatttaattaaagaagaagattagtaagaagatattgtaagaaaaattgtaattattgtttgtttttattttttttatgcaatagaaataatagattttatatgattatagaaataataaatttaaacttaagatttcgtgcaaaaatttcaaattctctcacctcattacatgaaatatagtatatcttttatttttttcattttgtgtgcaagttaaagaacattaattacattaaacaatattactatcattgttcgtatttataaaatctaattaaattaaaaatacatctttattcattactatttccgttcttatttataagatccaaattattaaaaaaacaatttaaatatttaattgaatatgattgtttggtacatccttaattgaatatgtttaataatttcttaagaaatgtgtggataatagttaacatgaggcttattttctttttattaatgctaatacttattaaattatatattttcatatttttgagatgccagatgtattggatttttaatttttaatacattttacaaaatgtacatagaaagtcaatataaataatataattaatttaaaagaaatagcattgctcatttactattttactaaaaatattaaatttttgccttatgtagttatgaacatttaatgtaataataaactaattctaatgtatattatattgattattgaacttctttaaaatatattcttaagggccctcgctatatagggctacacaaactacactcttcttggtcgatctcccacatttttctctacccctcgcgcgtgttaaattttttgaaatcctggttttgcagagaagctatagagaagaagattgcggcttgtgaacttaaggatttaagtgaagtca

SEQ ID NO: 39 - DNA, 5966 bp, Glycine max
tcgttgaaaacagaaaatggtgatgagaatgtatttggttggatttttgaaaacattttcagtgaaaatgaaaacagaaaataaccagaaaatgaaaataataaaatttcgttttcagcgttttcaattgaaaacaagaacctcattttggataaaatgaaaatgagatgaaaataaatgtaattttaagcaaatttaaaaatacaaaaaaagtcaatatatcataaattttcaatatttttatttcctaaaaacagaaagcaaaaagttaaaccaaacatatttttagaattctaatctttagaaaataaaaacaattttcaaaaaatgaaaataaaaaataaaaatataaaccaaacacacaatatttcagcttgtgagtgcaaaacatatgcacgtttttcatttaagtatttctacagataactagacgaattgaaagttgttataaattttacttcaacaaccaccttaaaagggacctccgcatgatgatgaacgccactagttagaccatctctaatctctctgcattcttgcatgataagagaataatgaataattctaacataaaattagcttacgacattttcgcctctattactaatttgctagtattttatctttatctacctagcttgcattctgcatatgaaatttgtggcatgtaattttattaatgctatttaaaccaatgaatatattgaagctgcttctatgaattttactttttaacctaacatcaaattaatgacaaagaaaaggttcaaaaaattattttgaagcactactcgatcagaaaatggttcaatgaaatataaatgcatagctacagtggtgaactaagatctataatctctatatatccttatatattctttcattgatattcctcttaaaagtacatccaattgattgaagccttatctttacatgtataataaataataaaaaattagagcaataaacatatttacagattaactgacttaattaaagacaataaatatactaaacaaaaagaataagactataagagcatgtctcattattattaaaggtaattttgaaaataatatataaatttaggataaattatatatataaaaaggaacaaaaggcagcggttgattattaaattagttaatttgttgatgacttgtaaatcatgagaaactaaagaaaaataaaaaaacacctcaaacttccaccaaatcaccatatccaccgacagccaaatcaagtcataaaatgtcgatgaacctccccatctaccttgatcatgagtttgggattcaattgtagtgcattgacacctcgctttcaaagcaccctccagcctaatttgtagagccagtcaaacttgattctctacttttacctttatttaaaaaatcgtgcttaatatataatgcaagtttatagtatacccattccctttcttcacaaaaaaaaaaaatgaggaaatagaacattaagtactaggaatagacagagaagtctttcttaagttgggactgggatctcccgatctggtgggcggtactgtagcttaataaatctgactggggctattaggtggtgttttgtttgggagtttatttttttattttttatttttaaatttttaagatttataagatatgtatcaataataaattactttaagtttaagatatcatgatattttttgtttttcagaaaaggctaaaaatattgattttttgttttcagttttggatctatttttaaaagaaaatatttttaaaattttaaaaaaatacatttttattcttattttttttatttgaaaataaaaacaaaaaaacactcaaatcacgcatcattctagattttgagtgtctttttttctcaatgacaagagactattaatattttttagttcacttggtcataaactaattccactattagattttgagtgtgtgttaataaaaaatatttattaatcaacaatttttttatcaacaaatattaattttattaatagagagaatcaaattcacaattttttttaatcattcaacccacctcatatctcccaaatctatcaccagattaaatctttctaccatataagaatcaaatttaaataaacacaattattatttagtgactaattttgtcttctaaaattagtatataagaaaatttcatatttaacagctccaataagtctcactatgattatataccaaaattaaactcttagaagaattgttactgaaatcattaatatatatttttatggagaaaccattaaatttcaaaagagtctttctattataaattataatttataaatatgcttaatcaatatttcgcactaataaataatagaatgtttgcttataattaatttaatttgcgacgctagggttgagaaatacaggagttaaaagaagttgttgagttcagtggacctaggtcacaaaataaaagttaaattaagcatgaatgatatcgcgctctaactctcttctgttcacgtatatccatttacaccagtcgtccctccataaatgcttctacaccctctgcaataactccatgctgccaaaccttctctcacttgttctatttatctcctcctgcgttgtttcgttctgtctctattttgctttggcccaaactaaaactccatcaactactccttcacttccctaattccccccacacccattcttgtttctaccgttccagtcatcatcaacataactaattaaggtttacaccactatcaaacgcttaaggtcccctctcgcatatacgcgtgtttaattttagctttgacttgctttgctttgcttagcttagttaatttctgagtgagagaaaggggtaacggctacgtcccccgcattgaaattggttacttgactagcgtaatcatctgttttgtcaaacctttcacactctctacccttattttgtcttttctgatttccctagcttttgtcttttggggtggcaagttttgcgtgtaagataagagtattaaggccaaccaaggccaggtaaagtcaccagtgcctctttgcaaccttaacataagaatgaatctccaaacaaacacttgaaagtgctgcatatcgatcagagacaaaacagcggcacgagctggtcgatgcttttatcagtttcagctttgcgagacggttccataaatcccaattgcaagtaccatcaaactttacagagggaaagcggtcgattcattgctgtcatcttcgtggttaatctaacaggtgatcacttccctaatttcttattttctctcctaattaaacagagatagaacaccttttcttttttgagttgaacagcaatttgactaaatggtaaaacttgtacattttctttattctcgatggggagatctggcttagaaattttttacatatagaactccgattattaatcgttgttgttgttatcaaatttgttcaatttaatgctttattgccaacaaattaagtttagtctttttgagtaatgtgagtacttttctaagcatctaataataagctattgaagctcaatttgcctaaagcaccaaacttaatgctttattattttttgttttataggatacttttacttactttataagaattacaaaataaaatttagttagtgattttatatttgtgaaacttttatattttttaaatattctgtaaattattaaaactctattatcttattacagtatttgtttttatgataaggaagtggaaggaaaatgaaaagaaactatattatttttttaatgtttatttgagtgggaaaaaaagtttcaattctaaggcccatgagaaaatataattccttccctcccaaatttggcatgaaagggttgaggggaaaaatgatctcttactcatttttatttttgtttttttaatatatatatatatatatatatatatataacatgattttttatataaaaaataaatgatttcaccttatgaaaaatagttaaatataaaaagtttgtcttttaaagttaattgtattttttttaattagaatgataaatataactttttttgtaaggcctgtggctctttcgtgcttccataagcatcactatgagactaacttaaacagttagcccttttcccctttccccctttttcaaatatgcaaaccgaactcgtctatttattttcacttatctaaataattacaggaaaaattctctacgtttttcttatttccatatatcaaaataatacattttttctattcttttaatattttgttttttatctttcttatttttttctctattttatttctaattcaaatagaacattaatttgtttctatcgaatctttgttacccataataaactgtgtgtagtgtatacttgtaggttttttttttttaaaaaaaaatccttctgtctgctcaattaacaaataattctaaatcatttaatattctcttactaattttcctacattctttatatgtaaatgttctatatcttcaaacaaaatatcccggtatacattaactaataaccgaatactctctctccgtcttaagtatcgatctagattaatttatccagataaaaaaaaagttaatacacgtatgaaaaaataataattttacaaaattaaatttattaaataaattaaaaaaagtactattggtattacattaaaaaactaaagtgaaacttactaaaagagaataattttaaatttgacttctggatatataattgtattaaatagttgtatacataatttctatccttgtacaaaattgtctataataaaaaaattcatgtgatttataccaattttttcccatacccatatatattaatcttgtaaaatgtttaggatatataattaatatttttaactagaactagaatttgaatttttacttaagtaaaaaaaaaactcattttagaattaaaatcacaattattatagcataactaaaatcaacccttcccaattatattttggaaccaattgaccttaatctcaattcaatttgtaaaaaaaaaaagcgtattaaatagaaaaaaatacattaatattttaaaatataagcaatatatttaatacatttttcatttaattaaagaagaagattagtaagaagatattgtaagaaaaattgtaattattgtttgtttttattttttttatgcaatagaaataatagattttatatgattatagaaataataaatttaaacttaagatttcgtgcaaaaatttcaaattctctcacctcattacatgaaatatagtatatcttttatttttttcattttgtgtgcaagttaaagaacattaattacattaaacaatattactatcattgttcgtatttataaaatctaattaaattaaaaatacatctttattcattactatttccgttcttatttataagatccaaattattaaaaaaacaatttaaatatttaattgaatatgattgtttggtacatccttaattgaatatgtttaataatttcttaagaaatgtgtggataatagttaacatgaggcttattttctttttattaatgctaatacttattaaattatatattttcatatttttgagatgccagatgtattggatttttaatttttaatacattttacaaaatgtacatagaaagtcaatataaataatataattaatttaaaagaaatagcattgctcatttactattttactaaaaatattaaatttttgccttatgtagttatgaacatttaatgtaataataaactaattctaatgtatattatattgattattgaacttctttaaaatatattcttaagggccctcgctatatagggctacacaaactacactcttcttggtcgatctcccacatttttctctacccctcgcgcgtgttaaattttttgaaatcctggttttgcag

SEQ ID NO: 40 - DNA, 456 bp, Zea mays
aagcttgctttcacatctcctccggtcctcctccatgtgtacaccaaacaaaccaagaagaaaaaaatgcatggttttgttcccgatttataccttggagcaacccttccattctcttgaaattttctttgtcgccccttgaacttccccccatatgtccagtccagctacaaattaatggcgacgagcgatgaaacgcacggaacatatatgcctcagcaggcaaacgtcccagtcgtcgatctctggcacttaattaattgtttatattaattccaactcgttcgtgcaacggtgcaaacaaaacaagctgacgatgtcgagtcgctgtttccccttccaccttaattgcttttgcagccaaacctcctgctggacaaccagcagctccagctactgcagcagcaacacctgctggaccagatcccggcgacgacggcggagagcggcgacaac

SEQ ID NO: 41 - DNA, 3000 bp, Oryza sativa
ttaaaaaaatctggaaaaaagaagcgatttaaaaaaggaaacaaaaaagtgacgttaaaataggagatcttaaaaaaaagaaacgcgtagggatgcagctggtgcgcgcgccggctcctttcccttgcgcgcacgcgcgctagcatcccccataagtttaacccataaattatatttgcttcgttcgtttctcaatggcttgttagtcataggtcaatcaatcagagtctagaaaaagaggtaattttttccattgttgagaagatattaggagatactatttttttagtgtgaaatttgatatctatactagctatctcggtataaaaattactttaaatgtaaaatttagatgcctcaatatatatacttttttaagaaccgtataatttctcatagaaaaaagcaatgaagacggacatgactctcattagtagtgtacttttttttttcctaatccactatatagtgtaccattatccattaatttcttttatcttttacaactttgattttgagggatttgcatactgttttgaaaggttgattgtggttatttctcacttgattagatgcatgagtttttaaaataatttaatttcaagtagatacaatactcatgtatagatgatataattgtgtattattccctccatcctacgtatttttagtgtttaaaatttgttagcatttcttgagtattattttcctaacccacctaattaaccactgaaattatttctcactagtttgcatcgctgggcatgatatttcttattaaggatgtgtttagttcacattaaaattggaagtttggttgaaattgaaacgatgtgacggaaaaattaaaagtttaggtgtgtaggaaagttttgatgtgatagaaaagttggaagtttgaagaattattttgaaactaaacacggcataaagtgaactctcgggaggccgggggcatcgtgaaataaaaaagaaatgttggatatcagagaaggggctctcgtattgaaattttgttaagaggggtgagtttcgaatcgggatcggcgagcccatactttaagaggatatcttgaaataatttcaccgtaaccttaatttacgctaaaatccctaaacatatttatattcgtggacatggcgagtacatgccacgtttcttctgctagtaatttttcacataaatttttttttctcagcaagaaaggctggctatatactccagtgcagaaagagtgaaaaagactacaccaaacaagcatgaggcgtgtggaggcatgaaaacagtacgtacccagggcacagcagtgaaaacatcgatctcttcaccctgcatggtgtctccttaaaatctgatcgatcgactcccaaaaatataagtaaaatactcgagtcaaaatgcatcagtttgcatgcatagtgaaacagcagcaagctggtcttccacaggatactttttgacccattcctcctatacatgcatgtaattaatcacaaagttgcaaaaaatacaatactatgattgtgtatttgtgtgtactatatataaaacaaataaattaacctagtagtaactgatcagtatcgatcgagagtcaacaaaatatatgtagactacgacgatacgtgtgtgccttcctgttttcttttgttcttatctttgggccgcactatacgctgcatctatactaaacagtagtgaaaaatctacctctccaccactcaattattacgccggtctataataattcgttgtataaattacggggcaacagtgaattattcatgtgctcttgcgtgtaggattgccaaacaactgtttcatggtcagataaatgaaaaaaaagcgacaaattggtaacaataaggaaatgttaattaatttatgacatgtattactttcattaaaaatataatagtttctgactatacatgtatctcggaggtacataaccaaaaattcttagaggaagtataaaaaaaatgttttcttgttattggctacgaggtctcccaaaaatccaatgttgtacaaatactatattacatgtcaatttgaaattgtgttaataagtaaaaaaggacactccaatttctccatatcctcaattgaggaaatataaaaacaaaatttgtttaaaaaaatgtttcaggaagtataaaaaatgttttattgttcttggctatgaggtctcccaaaaatccagtgttgtacaaacactatattacatgtcaatttgacattgtgttaataaataataagtcaaaaaaggacactctaatttctccatatcctcaattgagggaatataaaaacaaaaattggaattgaaagttgaaaccatgcaccactagtctctctctctctctctctctctctctctccccttccatctctttctctcccctagcaattacactacgccttctccataaatgcgattgcaccctctcaacactccgcggcaataactccttcgcccccctctccacattctcttccacctgtgttccccttttcttctcctcttcttcttcctctcctcctcctgatcctgatcgagaagatctcaccttgatctcttgccgtgtgatctctagctctcgctagccctctgaaccttgcagtttgttgtttgcacccggtgaaacatcttcttttgtgcaggtaggagagacagcaaagcagagataagagttctatatttgcatgtagttcttgtcttggatctcactggctggctgtctcctctctgcagcaaggttcgttgggctagcttgtgtgctagatctgtttctacttgcgtttgcgttgcttggcaagcaagatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagatataggagtata

SEQ ID NO: 42 - DNA, 3000 bp, Arabidopsis thaliana
ttctgatcgaaaccgagaggataatttggaataagtaataacgaataatttgttaacaagtcgctttttatagattccttgtgagaaaacgtctttatcatatcaaacgatttttggtgagttattaatcttgtcgcagcattaagcatatatgatgccactttaggtcgtcggttacgttaattaacttacataaaattagatccaagaaaaaaaaatcttgcataagaaaagaagaaagaactagtttatttattaagctgtgagtttatcctaaaatatagtttggcttgtaaactagaattacatatagcagctgcaaaaaatgatggtgatgatgattttcacattgacaacaacaattatacaacgttatgatggtcgtcaatcgatatcaactcgaaaatataatttagaacttttgcatatacataggcacacacatatttttgtatgtatgaacatggtttagtgtatagttgatagtttaaagacattgattctttgaatggtcggagcttttagtgcgtttggttggtcggatcgccttgaaagctaaaaaaagacaactttgtccgtatgtgttgtcctagttttggagtaatttattttcgaccgttttagccattagcggaaaccacctaactctctctatcaaatgttctttagcgttggtccgttgcaaacatttgatcactgtattaataacatcgaccatacgatgctgttttgttcgtaccaaattcaccgtagtaaacgctgaaactttttttatttttttgtgtgtgtgcgcacaaaacgctgaaactagttaaaatataaatatattggataataagtataaagtacccaatatatttgtatctatttatattcgtgacatttgaatcgagttttacatggtatcggagtaacgagacaatcgataccatattattgctttgacctaccagttaatcaatatatacatatttcaagtctattaactcgtaagtctaatacaattagaaaaatgaaaaaaaataaaagaagaagatatatatggaaatattggcatttgtcttaataatgtaatcaatcatcaattgtagaagccaaaggcatctctagtgtcaacgaatttgaattgatataccaactaacatactttcaaaaccggtagattatacggtattggaagatgatgaaaagaagagtttatttctcttcaaaagttacaaattatataaatgtcatataccgtaagatgagatagttgaatattcacgtggtgtttatagtgtctacataggtaaaagacattaatcatacaatcgtattaacaaaattgattgtaaaaaaaaaaaaaaaagggttgattgtaagttcgtaacctctatgtggactgtgtggcccaaaccaatcggtcggaagctacaatactgtgtccgaatcctaaaaggctaaaaactgactcggaccagcttagagatcatatgaaattatggatagcggaatagctggcaacttcaatgaattctgaatttaaaacatttttttttatatatatagatgatttggcgattttcgaactggaatggtgaaaaagtggttgagtacactattagtttatttatttaaaaaatagagggaaattcaaatgaaaaaaaaagtttcatctacagaaaaaaaaacacgtcaaaattccaaaaaacttgaacgtcttgaacaacggtataaccgtataagaaagggaacttaaaacttaaacgtctacatgattgaaagggtaaaaatattcatattacaatggtataagaaaatggagaagccagaggagcaactccaaagaagaagatgcagcaagagagtgtacattattataattataagttggtatatatgtagttgctaaaaaaaaaaaagagtgtacaatattttctgaagaagcatcgagctggttaatatttaagacccaccaaaacctaccaacaatgttattctcatctctaagcaaaagtttgatctcatctttttttttaattttttttttgatgggtcctcttctacctctgcatctccacgtgctatacaagtggcctcgctgtatgtattatttaccactctcttattgttactaaaaacttgaatgtcacttgaatgtcacttgaatgcaaactatatatttaggtgaataccagatcaaatagcaataaataaaccaacaatttatgctaattaaaaacttgaaaaaacactttccattacctatgattttttaatccaatcttggggtttgatgcccataaaacgaagtcgaaaagagaaaagcgaccttaattgtaataaatgcagctattgacttctctatcaacttcaagtcttcaagtaactacaaatttaataatctccttagcttatcttagagaagcacaaaacaaaagggtctacgcttagtcttcctagattcttgatttgagtcttgatggccacttgctttttatgtctcaatcctaagagttgatacttacttagtattaatcaggtttcacattatctcagacctagcttgcatttttgatacaaacatgtcatgcaatacacataagcaacacgtaccgagtcattgattgaaaaacatgacctaaatagtaatacggactgagagagagtgatgaatcatttcatatgggagacagctttctcatacgcgtccatgcctttgcatgaaagattaaataattcaactctttcacttatcttattttaatttactttgcagaattccaagttttattgcaatcaccaggggtattaaatgggatagtgtaaatgcacctgcaacacatcaactaaccacacactcctccacctgtttgtatttacttcaaaaacttaattcaaaaatccctttgcttctttccttccctctatttataaaccctagtatccggtttttattctaccacacaataccatttgcaacaaacttctctctgaatctcagtgaattctcataaa

SEQ ID NO: 43 - DNA, 2546 bp, Glycine max
aaaatatattaaaagcgtgagtttatttgtttatactttttgcaatatctatatttttaataataaattaagatcttcaattttattatacaatatttcaagattaattgaaacattttttttttcaattaattcccgtccaaaattttcaattgtctaattattatgactgcttagtcttattaataaaaataataataaatgatgtatcatatcatattaagatttatcaactataatttaaattaaaataagtgtttttttaaaataaaataaatgattttataatttttttgatgcatttgtttaattttttatttaaaataagtaattttttgttttcttaaaaccaaccctatctgcttaatcatttttctaaattttttcaaaaaatttaaacaaattagttcataatattttatgactttaaataattcagtaccagcaactgcctcattgactttgcacttgccactgtcctgcctttgcacgaaaaataacatataaataacgcgtagcactgttttctatatctaaattagtctatataaaacataataattacataaatattcggagattttataaacaccgacaaaaaataaagtttaaagtttgtgatttttatgtcaatttctttttattcataagaattgaactcaaatataaaaaaaatttataacaacgtacaactaaattagactcattgatatttttatgtgaaatttaagtttaaccaaacaatatttatctagatatatgcataaagaaagagttttttttttagtttatacttagaccaatttttattttattttttatggaaacttagaacagatgttaatgagcagaaatatcaattatgaaataaaaatacaagtaattaatattttattttagttcttatagctcaattttttaataacacttttttggtccttgttctctaaaattatttaacgtaattacatttagatcttttaaaagtgttacaaaactgcaacggatagtgtaaattaaaaccgctaaaaagagatttgggtaaattttaatggtcataaataaatacaacaacaacgccttatcccactaggtgagtcggttacatggatcaacttccgcctaatcgtcataaataaataaagaaaagaaaacaagactttgttgtgccatcaaccatggccaaggcagaatcacgcgtgacaaactttcataaacgaattgagaaccttattggcattgggtcagagccatcggcgactgtgcttgttttgttgacggatttacatcatcaattccagttttgtaacaattttgaagaatatggatgtttgcattaggcaactttagacatccaataccaaaaggtttaacaattgtaactatatggaccaaaactcctattttaaacaataggtatcaaaagctaattaaacttttattaaaatagcaagcctaggaagcatacgtgtgtatatactaaaattgctgcatgagtgaactacacaaattcaatataattgttcaccatacttcagacaaaataatgttggcccagtcccatttaatgtaagactcaaaatctatgccagttgacccgaaccacacacaaacaatggtagaaatttggagtacgtatattggccacagtagcctactcaactgaaaagcaaccaacctatgaactttgctagctgtttccaagccatagcaattaaacttttccccttttacttttattttcttgaaatttttatgtaccaaggtgggttggaaatttcaaattggtaaatcaggttaattcctttctattagctaggtgcactcaatcttccatgtttatatacactataacattttatacagcatcaccttctgtatgtctatttattaatacagaaaagcatacacatactatgtattgattgccacagcctggtacaatcagccacaactgtttctcaaagtaacttgtatattgatattcatttatacctaagggtatgtctctatcctgctcccacaaatgtgggggaactgtgttgtagatttcactttcaagcgattgatattatatgttcaaggtaactcccctaattaatatattgaatgagacaatttgtgtaatgctaaataaggtttctatatcctaaacttctttagagtaaacatatgctaagaaaatggggtgtaccttcaattagtaccaaatttgcacacaagttgcttaagcttaattttgaaaaaaaataaaagggtttggagagagaggatatttggatgtattagacatgtgctcaaggttttttcagaaaatttcaggctatattacaagaagtagtgaattaatatcatgagtaaatgcaccctgcaaaacatcaactaaccacacactcttcccacccgctaatatttacttctcacttctgtgaactgttttatattccatgctttctcccttccccaaaccacacttcaaaatcctctggtaacccttattttatctattctctctctttcttttgtgttctaagcagctagaagca

SEQ ID NO: 44 - DNA, 2500 bp, Glycine max
aaaatatattaaaagcgtgagtttatttgtttatactttttgcaatatctatatttttaataataaattaagatcttcaattttattatacaatatttcaagattaattgaaacattttttttttcaattaattcccgtccaaaattttcaattgtctaattattatgactgcttagtcttattaataaaaataataataaatgatgtatcatatcatattaagatttatcaactataatttaaattaaaataagtgtttttttaaaataaaataaatgattttataatttttttgatgcatttgtttaattttttatttaaaataagtaattttttgttttcttaaaaccaaccctatctgcttaatcatttttctaaattttttcaaaaaatttaaacaaattagttcataatattttatgactttaaataattcagtaccagcaactgcctcattgactttgcacttgccactgtcctgcctttgcacgaaaaataacatataaataacgcgtagcactgttttctatatctaaattagtctatataaaacataataattacataaatattcggagattttataaacaccgacaaaaaataaagtttaaagtttgtgatttttatgtcaatttctttttattcataagaattgaactcaaatataaaaaaaatttataacaacgtacaactaaattagactcattgatatttttatgtgaaatttaagtttaaccaaacaatatttatctagatatatgcataaagaaagagttttttttttagtttatacttagaccaatttttattttattttttatggaaacttagaacagatgttaatgagcagaaatatcaattatgaaataaaaatacaagtaattaatattttattttagttcttatagctcaattttttaataacacttttttggtccttgttctctaaaattatttaacgtaattacatttagatcttttaaaagtgttacaaaactgcaacggatagtgtaaattaaaaccgctaaaaagagatttgggtaaattttaatggtcataaataaatacaacaacaacgccttatcccactaggtgagtcggttacatggatcaacttccgcctaatcgtcataaataaataaagaaaagaaaacaagactttgttgtgccatcaaccatggccaaggcagaatcacgcgtgacaaactttcataaacgaattgagaaccttattggcattgggtcagagccatcggcgactgtgcttgttttgttgacggatttacatcatcaattccagttttgtaacaattttgaagaatatggatgtttgcattaggcaactttagacatccaataccaaaaggtttaacaattgtaactatatggaccaaaactcctattttaaacaataggtatcaaaagctaattaaacttttattaaaatagcaagcctaggaagcatacgtgtgtatatactaaaattgctgcatgagtgaactacacaaattcaatataattgttcaccatacttcagacaaaataatgttggcccagtcccatttaatgtaagactcaaaatctatgccagttgacccgaaccacacacaaacaatggtagaaatttggagtacgtatattggccacagtagcctactcaactgaaaagcaaccaacctatgaactttgctagctgtttccaagccatagcaattaaacttttccccttttacttttattttcttgaaatttttatgtaccaaggtgggttggaaatttcaaattggtaaatcaggttaattcctttctattagctaggtgcactcaatcttccatgtttatatacactataacattttatacagcatcaccttctgtatgtctatttattaatacagaaaagcatacacatactatgtattgattgccacagcctggtacaatcagccacaactgtttctcaaagtaacttgtatattgatattcatttatacctaagggtatgtctctatcctgctcccacaaatgtgggggaactgtgttgtagatttcactttcaagcgattgatattatatgttcaaggtaactcccctaattaatatattgaatgagacaatttgtgtaatgctaaataaggtttctatatcctaaacttctttagagtaaacatatgctaagaaaatggggtgtaccttcaattagtaccaaatttgcacacaagttgcttaagcttaattttgaaaaaaaataaaagggtttggagagagaggatatttggatgtattagacatgtgctcaaggttttttcagaaaatttcaggctatattacaagaagtagtgaattaatatcatgagtaaatgcaccctgcaaaacatcaactaaccacacactcttcccacccgctaatatttacttctcacttctgtgaactgttttatattccatgctttctcccttccccaaaccacacttcaaaatcctctggtaacccttatt

SEQ ID NO: 45 - DNA, 2763 bp, Sorghum bicolor
cgaggtgctgtgcagatggaatggctactcacgctgacatttttcaggtgagagatcagagttggcaagggacgaaggaatggaggttgggatgggatgggatgggatgggatgggatgggggttgagagggactgacagcacgccaagctagctgaattaagcaaagttaaataagcttatgttggattagtagttggcatgttgggcaggaaagcaatccaggttaaaaattgcttgagggttgcaacctgcaaggctttgcttcagagtggctcaaatttgggtaggttttgatggcactcttttgattttgacaccaaatctttctcgcgacattaactatataatttcctattttaaccactttttagaaatgaaaattattagcacaataaagaagcatttgtaatgcgatatttttttttctgaattctcaagttttttttagatgaagatccttcaaagttgaaatttgttagtaccaaataagcccataaaattggaatgagcttaacgtgaatattccccggacaacctagtcatgacacttgttttggcagagtgaggacccatggtgtttggcattgcagcacagtaccaatctgccactgcctgatgagtgatgatacaagagcatcatcgaaaagcaacagtagatgacaccaggttttggaagggcagccagcagctttctgaccaccaccagacgtatatgaaacaaaagcaatcaggagagcatatcaggtttggtgagaaaagttgtgttaacaaatgaagactggaattccttgactgatcgcaagatgctaccagcagcaaacacttagaatgtaagctacaggcgtgtcaggagctaaagttttgcagataggaggtggctctcagcttctctctccgttgccttcaagtgaagcctcggcaaaaccgggcatgaaacacgcatcgcccgccccaattccttgtgcagtccaaaaggaccagaaccatttcacagtttcacagttgcattgacaggaagtaattcgaagacacgacataccgacgccagtaacaatataccataaaaagcatgggttgatgggttggtcatccaaacagaagattagctgataaacagacaaagggatgtgaaaacgaaccttttatggtagcaggtagcgatggcaatgctctatcttcttttgcagattttctcatgaatatcactgctaaagccagttttcatcaactccataaatcgaaagcgaaggggcataacatcagttcctccatactttctacccagtttcagtatttttgtgcggtcgtagctaaccgcagggagcattcttttggcacattcaactattggaattcgatgaccatgccaaacatcttaaaaccttccatcaaccgaaagtacaagtacaacatacaacggatatagatggaaactttcgttcataaagtttggtatcggcaatgtatttactaccacttaacagatgcatctctggcatccctgcagtaaagaagcagtaataggaacagaagaaaggttttacaaaatctcacgggtatcatgatcatcagttcattgccaggtgtgaccatagataaaccacagcaagatgtaaccaggatcatgcagtcccgcaccagtaggctaagtgctcgtccttgcgagatgtgctaaagagcccaccacatttcaggcagatgaagctgctcccatcagcaaacgcatccaggatgatctgcttccttccactctcagcaagaatgcaggcctcatcagaattcagcatatcgacagggtctgacccaggtccttgtgaagggttagtatttgttgactgagcctctgctatggcacattgggcaagcaaagaggcaagctcatcaacactaggagtggcctgcaatctctgcgcatagagttcacgcgcacggttcattgtctgcatgagcgcttgttcaccaccttgagatcttatggccaggagaacctgcatagtttcataacatgagaatcaatataacagatacagatgaatgggcatgaaatgagacaaatgagtctcaacgaaacaagataaagttcaaaaggttaataattaccacaaggctcatcattgggatctatacgaacaaaattgaaacagccttccagaaggaatcaaaatagaaattatgcatttcaatagaccagaatgcttgtcacattaccaatgtttgattcattaccagaacaaatcctacagtgttattatgagggacacatcaatcataagatcccacaggaaacagctaaggcataatcttatattgcgtaaatgttggtctaaaaaaatcagttacactaacataggcacatagctatggtgcaggcaggaagcactaatgacagagtgtggtgttgcagttgagaagtaattagcctactactccaatccacagagaagacgtgcatttcattcgatccatgtgatacatcaggtaatatgctatacatgtctaatccaaacaagatacggaaattccaatttaaccatcgcacactaatacatatagagaaagatttgtttaggcctatattgccctgtactcctgtgtaaatttagtacagtatactcaaataattttatgagggtaccaaacactaattgtgggctgtggctttcttcttcaacttttcccaaaccaaccttctacttttacccttactcaccaatataagggctcgacggtcatttttaacaggtcaaatccaaaatgattg

SEQ ID NO: 46 - DNA, 2567 bp, Oryza sativa
aggtagcataagaccatcatctttttccctttctaatatattatactacctctatattttaatgtatgacgccgttgacttttcgtccactatttgaccattcgtcttattcaaaaaatttacttaattatcatttattttattgtgacttgattcaccatcaaatgttctttaagcatgacataaatattttcatattttcacaaaaaatttgaataaaacaaatagtcaaacattagtaaaaaaaatcaatggcgtcctatattaaaatacggagggagtagtttttctaaagtatcctgtgaatcacacgcgcatatgtagcttgcatagttacacaaaatatgcctcctttaaatgccggagctaccaaaatgggctcataatagcctgaaattaagtagtcccttcaccgacaaaacactagttactactgtatcatcaacaacgacctgaatttacagtaggggagaaacagcttgaatataagctgaaataagttgaacccataccatcatcgctagtgaagagtttgattgcagataattagttatgcttagtataaaatgcaaaaatccatctgatctataacaataggtaaataaatcacatctctaatttatttacccatgctggttctttcagaaataatatttaaatactttgaaagttgcgttgaagacagtcggcccggatattaaggttcaactttatttcttttttcatcaattagtttatgcaattctgcccaatgatattgttactagtaaattttacagacagtagccaacactgtggatttatttattccataacccatgagagagatgtgataatatgcacacactactaattcagtacagtgatttaatatcacttatatctcatcatatcttggatgtcatgtagaataccaagtcaatgcaaaatctattttctttttttttcaccattaaatctttcaccaaatcataaaaaatcttatgtggcggctagctcatttaatcctatgtaaaacatcttaggtcgagtattaggactgtgccaacagaaatactatgtgctagcccagctttcaggggcccaacaatcaccaaagtaactctgcccttcggaaaattaaaggcagccactcagacacacagtgatatccagcaaatgcacgacggatcacatggagtttcagccccagggccaatcacatcttgcgcaagtacagccgttgctggtatcttcaaccattcctctattatctcctggcctggtcctgctcagctgcaactgtaacggttagttcagtcccatacttcttccgtttcacaatgcaagtcattctaccatttttcacatttatattgatattaatgaatctagatatatatatttgtctagattcattaacatcaatataaatgtaggaaatgttagaatgacttatattgtgaaatggagggagtatgtacgtatggtttcagagagttcgactgttccagaagttaagggcaatagacagttggatgcaggctactagtcattacctggtaattttctgcctttttttgtggtcattgtaagtaattcttgacaggagatcacacatgcatagctccatttcatctgcaatgtcagacgctgtcaagattaaggagtaggagttttgtttataggagggacgaaaatgtgagtgatggatagcatgatgaaatcgcaggtgcgatattgatgaatgactgcagcagcattacactaattgctatatatattttttatttaagagcagcaaggtctgtttgtaactaaaacagaaatgttttcaattaaaaaaaactaacagcacaaggtctacagcataccaagtaaactaacgctagctagaagcagccagatagatcagaaaaactcgaaaactttgcagcacaattctgtaatgtaatgtgctgataatgtatagcatgaaagactgcggcacaaatcagttccaagaaacttacaagaattaacaagcggaattagaccaaagcatcgctttttacacaaaaacaattgtaaaatcaaatttggtgcttccacataacaactgggccagggaatcttaccatactgtgcttccattaaattgagaaattcaattttgccaccacagcatgaaatccagctcgaggcatggttaagtgtactgagtaggtggcaagcaccgatccccattaaatcagcagactttcggggaggaaatccattctgcatggaaagaagactgccaatatccatggaagctaaaagtgccatggcctcgctctaacctacaaatttggacacagatttgagttaaagaactcacaatggaagcttcatcatgtgaattgaaagcgagcagatcaccgtcatgctgaactagctggacgaatcaaaccattaaatgatagacaactactaacagtgtcaatggaactgtagagcatctttcgcatgtatatataggcgcacaaaggcaattcagttcatcagctcaagcacctcaaccagttcagtcatccattctgtcttctctgcagatactgagagccaag

SEQ ID NO: 47 - DNA, 2500 bp, Oryza sativa
aggtagcataagaccatcatctttttccctttctaatatattatactacctctatattttaatgtatgacgccgttgacttttcgtccactatttgaccattcgtcttattcaaaaaatttacttaattatcatttattttattgtgacttgattcaccatcaaatgttctttaagcatgacataaatattttcatattttcacaaaaaatttgaataaaacaaatagtcaaacattagtaaaaaaaatcaatggcgtcctatattaaaatacggagggagtagtttttctaaagtatcctgtgaatcacacgcgcatatgtagcttgcatagttacacaaaatatgcctcctttaaatgccggagctaccaaaatgggctcataatagcctgaaattaagtagtcccttcaccgacaaaacactagttactactgtatcatcaacaacgacctgaatttacagtaggggagaaacagcttgaatataagctgaaataagttgaacccataccatcatcgctagtgaagagtttgattgcagataattagttatgcttagtataaaatgcaaaaatccatctgatctataacaataggtaaataaatcacatctctaatttatttacccatgctggttctttcagaaataatatttaaatactttgaaagttgcgttgaagacagtcggcccggatattaaggttcaactttatttcttttttcatcaattagtttatgcaattctgcccaatgatattgttactagtaaattttacagacagtagccaacactgtggatttatttattccataacccatgagagagatgtgataatatgcacacactactaattcagtacagtgatttaatatcacttatatctcatcatatcttggatgtcatgtagaataccaagtcaatgcaaaatctattttctttttttttcaccattaaatctttcaccaaatcataaaaaatcttatgtggcggctagctcatttaatcctatgtaaaacatcttaggtcgagtattaggactgtgccaacagaaatactatgtgctagcccagctttcaggggcccaacaatcaccaaagtaactctgcccttcggaaaattaaaggcagccactcagacacacagtgatatccagcaaatgcacgacggatcacatggagtttcagccccagggccaatcacatcttgcgcaagtacagccgttgctggtatcttcaaccattcctctattatctcctggcctggtcctgctcagctgcaactgtaacggttagttcagtcccatacttcttccgtttcacaatgcaagtcattctaccatttttcacatttatattgatattaatgaatctagatatatatatttgtctagattcattaacatcaatataaatgtaggaaatgttagaatgacttatattgtgaaatggagggagtatgtacgtatggtttcagagagttcgactgttccagaagttaagggcaatagacagttggatgcaggctactagtcattacctggtaattttctgcctttttttgtggtcattgtaagtaattcttgacaggagatcacacatgcatagctccatttcatctgcaatgtcagacgctgtcaagattaaggagtaggagttttgtttataggagggacgaaaatgtgagtgatggatagcatgatgaaatcgcaggtgcgatattgatgaatgactgcagcagcattacactaattgctatatatattttttatttaagagcagcaaggtctgtttgtaactaaaacagaaatgttttcaattaaaaaaaactaacagcacaaggtctacagcataccaagtaaactaacgctagctagaagcagccagatagatcagaaaaactcgaaaactttgcagcacaattctgtaatgtaatgtgctgataatgtatagcatgaaagactgcggcacaaatcagttccaagaaacttacaagaattaacaagcggaattagaccaaagcatcgctttttacacaaaaacaattgtaaaatcaaatttggtgcttccacataacaactgggccagggaatcttaccatactgtgcttccattaaattgagaaattcaattttgccaccacagcatgaaatccagctcgaggcatggttaagtgtactgagtaggtggcaagcaccgatccccattaaatcagcagactttcggggaggaaatccattctgcatggaaagaagactgccaatatccatggaagctaaaagtgccatggcctcgctctaacctacaaatttggacacagatttgagttaaagaactcacaatggaagcttcatcatgtgaattgaaagcgagcagatcaccgtcatgctgaactagctggacgaatcaaaccattaaatgatagacaactactaacagtgtcaatggaactgtagagcatctttcgcatgtatatataggcgcacaaaggcaattcagttc

SEQ ID NO: 48 - DNA, 2602 bp, Populus trichocarpa
aacagcctgtgctgtcaaagagaaaccattgtgtattttcttttcattacaaaatctaccatcttactcactagtacaagatctaaatactccaacaagagcttgatcttgttttcaatggtctggtgtaagacaccattaatttatttgaaatggggatatgagatataatcaaatagtggaggttgtgggctagcagggctcaaatctttatggtgtattggaccaaacaaaattggggcaggatatcattgttcttgggctcaatatttgttagcttgtccgatgagagaatgaataggaaggcaccccccccctgtgtctcttctcttccagatttaataaattagaggaaaaaaacttaatgtgccgctcgggaaatgaatcatttctagtggtttaagtcgggaccagctgaacggagtctctgaaaaaaaaaaaacgtagtcctgaattcaaacagcttaaagtctaagagataatgaaacacggtgagggttcaatcccatggcatggagcaagttgagacatgggttttgatcagttttattgaggttggaattgaatgtcacattcatcactcggggatgttgcagcaccagatggccttacaggaaaatcatgtctatgtgcttttgagcctacttctatagtttaatctcagcttgtcaaatgaagtcaacttgatcctacagtatcactgtatatgaacttgttctataatcttgtcatattggtggtgaattttttttctaatgaattttgtgaagaccatgttataaaaagactcctaacaatgcctagatcaccacaataaaatggcatggtgaagaaaaaaataaaattatctttaatatggcgagaaacatacttaaaaccaagaaaatgccaaatgaattttgggttgaagttataaattatgttatttacttgttaaataggttttctatgaaaagcttaaatgacatgactctattataaaaagcatgcatggaatggaagaaagtcaagtgttactcatttgaaagtaattagaagcattgactatatgcatgcagatgatcaagtaaggaccaaattagatgacaaaagcaaaaaataatctttgtgagctataatcaaaagtcaaaataatacaagtttcacaaccctaataaataaaaaatgatgattaatagaaatgtcgaatttgatgaagaaagagcatgaaattagaaggtagacgatgttgagaagtatgaatttctaccagtttttgatgaagagatataaagatcatcaataacttgttacacctccacaatcatcaataaactcaacttcacctttatcctcttcttcttttagtagaagttccagtagtggcagctcacttagttaatatagaaagatgaagagtcttgatgacttgtataagataattaatccaattgatgatgatctatcactatattgtcatcttgctacatgtaaatctttagtgtttgtaaaagaaataaatgatgaaaaatagagaattgctataaataaagagattgcatcaactgagaagaatgacacatgaaaatttgttcctagaccaaaaagaaagaagacaataggctaagaagaagcaacctatagtcacattattaacttgagaagatgaatatgtatctactacaacaagtgtttgtcattccatatggctaagaaaattattgaaagagttatgaatgccacatgagaagcctacaaaaatttatataaacaactcattagtcattgctttaactaagaatccaatatttcataactgaagtaagcacatacacacaagatttaatttccaataagattgtattacaaacaagaaagttgaagtcaaatatataaaaacacaagatcaagttatagatatttttataaagccactcaaatatgatgtttttgtcaagatgagaaatatgctatgagttataaagaaatcaattttaagaggggatgttgaaagtaaactagattttagtttttttgcaaaatagaagaatcggtcgatcggttcagaaacaattaaccaataaagacgacataatacattttcttatttgcctagaacctgaggtttataaataaaattttaatctaaggaataattaatatatgtaaagagaaaatctaaggaataataaaattgtttttttattgaatcctcttcttgttttttagttttacttattattttgctgttaataaactcctgccacacttattattattttttttttccaatataataattcatttcgtagtaaccttggcaaaacctccatggcaatggtggcaattcacacatcagagttcttaaaacgagagaacaatccattagcaagagtgagcttgggcatgtggcgggggttggattaattgcattatcgcatcagtgcaagtcattaatagcacaaattaatgctccggcaacaaatcaactaaccacatactccttcacctgctaatatttacttcactctgtcaactctatataatccccgctttcttcactgaagaatgcacctttcagttatatcccaacttacttctagtgttctccaagaatattgag

SEQ ID NO: 49 - DNA, 2500 bp, Populus trichocarpa
aacagcctgtgctgtcaaagagaaaccattgtgtattttcttttcattacaaaatctaccatcttactcactagtacaagatctaaatactccaacaagagcttgatcttgttttcaatggtctggtgtaagacaccattaatttatttgaaatggggatatgagatataatcaaatagtggaggttgtgggctagcagggctcaaatctttatggtgtattggaccaaacaaaattggggcaggatatcattgttcttgggctcaatatttgttagcttgtccgatgagagaatgaataggaaggcaccccccccctgtgtctcttctcttccagatttaataaattagaggaaaaaaacttaatgtgccgctcgggaaatgaatcatttctagtggtttaagtcgggaccagctgaacggagtctctgaaaaaaaaaaaacgtagtcctgaattcaaacagcttaaagtctaagagataatgaaacacggtgagggttcaatcccatggcatggagcaagttgagacatgggttttgatcagttttattgaggttggaattgaatgtcacattcatcactcggggatgttgcagcaccagatggccttacaggaaaatcatgtctatgtgcttttgagcctacttctatagtttaatctcagcttgtcaaatgaagtcaacttgatcctacagtatcactgtatatgaacttgttctataatcttgtcatattggtggtgaattttttttctaatgaattttgtgaagaccatgttataaaaagactcctaacaatgcctagatcaccacaataaaatggcatggtgaagaaaaaaataaaattatctttaatatggcgagaaacatacttaaaaccaagaaaatgccaaatgaattttgggttgaagttataaattatgttatttacttgttaaataggttttctatgaaaagcttaaatgacatgactctattataaaaagcatgcatggaatggaagaaagtcaagtgttactcatttgaaagtaattagaagcattgactatatgcatgcagatgatcaagtaaggaccaaattagatgacaaaagcaaaaaataatctttgtgagctataatcaaaagtcaaaataatacaagtttcacaaccctaataaataaaaaatgatgattaatagaaatgtcgaatttgatgaagaaagagcatgaaattagaaggtagacgatgttgagaagtatgaatttctaccagtttttgatgaagagatataaagatcatcaataacttgttacacctccacaatcatcaataaactcaacttcacctttatcctcttcttcttttagtagaagttccagtagtggcagctcacttagttaatatagaaagatgaagagtcttgatgacttgtataagataattaatccaattgatgatgatctatcactatattgtcatcttgctacatgtaaatctttagtgtttgtaaaagaaataaatgatgaaaaatagagaattgctataaataaagagattgcatcaactgagaagaatgacacatgaaaatttgttcctagaccaaaaagaaagaagacaataggctaagaagaagcaacctatagtcacattattaacttgagaagatgaatatgtatctactacaacaagtgtttgtcattccatatggctaagaaaattattgaaagagttatgaatgccacatgagaagcctacaaaaatttatataaacaactcattagtcattgctttaactaagaatccaatatttcataactgaagtaagcacatacacacaagatttaatttccaataagattgtattacaaacaagaaagttgaagtcaaatatataaaaacacaagatcaagttatagatatttttataaagccactcaaatatgatgtttttgtcaagatgagaaatatgctatgagttataaagaaatcaattttaagaggggatgttgaaagtaaactagattttagtttttttgcaaaatagaagaatcggtcgatcggttcagaaacaattaaccaataaagacgacataatacattttcttatttgcctagaacctgaggtttataaataaaattttaatctaaggaataattaatatatgtaaagagaaaatctaaggaataataaaattgtttttttattgaatcctcttcttgttttttagttttacttattattttgctgttaataaactcctgccacacttattattattttttttttccaatataataattcatttcgtagtaaccttggcaaaacctccatggcaatggtggcaattcacacatcagagttcttaaaacgagagaacaatccattagcaagagtgagcttgggcatgtggcgggggttggattaattgcattatcgcatcagtgcaagtcattaatagcacaaattaatgctccggcaacaaatcaactaaccacatactccttcacctgctaatattt

SEQ ID NO: 50 - DNA, 2134 bp, Setaria italica
tttggaccatgtttagttcctccaaaactcccaactttagcactatgcaaaaagaagattctccatcacatcaaacttgcggtacatgcatggagtactaaatgtagacgaaatcaaaaactaattgcacagttttgttgtactttgcgagacgaatcttttgagcctaattagtcaatatttggacaataatttacaaatacaaacgaaacgctagtgtgctacagtgctacaacagtaattttgcacctccaaactttggccaaccaaacaagatcctatatatcggagttcgttctacgacgacttgcactacatgccccgtttaaatgctcagctagtcagctaccaaaatgggctcataaagtcataatagcagcggactccttccaccgacaaactcccaccctcctctagtcacccgcagcatgccaacatgaatttcagctgaaacagagctgcaccaccacccaagcacgcaaacaaatttgagcaagtaaaattaattgcaccgcaagaacagtaaatgcaagtactgttagtatattcggccaatgagaaatgaacgcaggagagatgtttttcgtacatgtgctttcttgaaggacccctcgcatcaccactcatcaatggaactgcgtgttcaaaaatggcggccacagagcagcagccgctagcttccgtctgtccgggcccccgaactctctgtaaagctccggcagatccacaagagatcacatggcagcccgatctccccggggccaatctcctcttgagcaagaccagctgctggcctctcgcgtccttgtgcttcctccttgattggaaggcagcctggtgttaaaggtgagagcacagtaaatttggtttggtactccttccgttccaaattgtaggtcattttaattttttagtttataaatattattatgcacctagacacatgtttctgtagttgtcttcctgtaaggaaaaggaccttgcaaattgaacccatgtactgatggtcatttctgaacttcgcacatgaggtcagtacggtcagtccatgtcgtagtaattccgaaggaaactgcacatgaatgactcatgtatgatgtatattagtaaaatgctgccatgatgtgaaccagcaatacgatagcatgtgcgacgatgttgtacaaaacagaggaggcccttgtaaaagacagacggcattacattcaggggctaaaaacatggtaccatacaggtgagatatgatggatgaatgcgggcagcagcccactgcgactacagtatacgcactaaaacctcggcagatgcaatcagaataatacacagaaacgcagaggactatcagactatgcaccagtattctgacagagtataagcacacttttgaatatgcagcagtaaaagatgcagtgaaatcagttttaaagaagttaccagattttccagtaaagatatgagacttgtgatgaaatctggccaaatcctgtgcctttcagttggatcacaaaataccttcagccgctccatagttattcagaacaaactcgagttagatccctcgaccctctgtttcgctggaccagccaaacccatgtttccattaataagttcgatagattcggtatttcaattcagggatcagatcgccgaatccagctcgaggtatagttaggtacactgagtaggtgggaggcaccgattccgattaaatctgcagtctgggaatagaaaagatcctcattttctgtcaaaagatgcctgcccaaaatccacgaagctctaagctatcacagttcacagccttagtgcccttttcctttttttttgcacaatatttgtagaaaagaatttgggctaaaatactcagtaccttcattatgctagttgagagcaagcagatcactgccgtgacaagctggacaaaccaagatcattaaatgttggccaactactaacagtgtgatgaacatgtacacatctttgcacgcaatagcttcaatggaactgtggagcactgctcgaatgtatatatatgtgcctgaagggaactcagttcatcaactcaagcatctctaggttctcaaccagttcttaggccacatattcagtcttgtctgtagacgttgagagcaag

SEQ ID NO: 51 - DNA, 2056 bp, Setaria italica
tttggaccatgtttagttcctccaaaactcccaactttagcactatgcaaaaagaagattctccatcacatcaaacttgcggtacatgcatggagtactaaatgtagacgaaatcaaaaactaattgcacagttttgttgtactttgcgagacgaatcttttgagcctaattagtcaatatttggacaataatttacaaatacaaacgaaacgctagtgtgctacagtgctacaacagtaattttgcacctccaaactttggccaaccaaacaagatcctatatatcggagttcgttctacgacgacttgcactacatgccccgtttaaatgctcagctagtcagctaccaaaatgggctcataaagtcataatagcagcggactccttccaccgacaaactcccaccctcctctagtcacccgcagcatgccaacatgaatttcagctgaaacagagctgcaccaccacccaagcacgcaaacaaatttgagcaagtaaaattaattgcaccgcaagaacagtaaatgcaagtactgttagtatattcggccaatgagaaatgaacgcaggagagatgtttttcgtacatgtgctttcttgaaggacccctcgcatcaccactcatcaatggaactgcgtgttcaaaaatggcggccacagagcagcagccgctagcttccgtctgtccgggcccccgaactctctgtaaagctccggcagatccacaagagatcacatggcagcccgatctccccggggccaatctcctcttgagcaagaccagctgctggcctctcgcgtccttgtgcttcctccttgattggaaggcagcctggtgttaaaggtgagagcacagtaaatttggtttggtactccttccgttccaaattgtaggtcattttaattttttagtttataaatattattatgcacctagacacatgtttctgtagttgtcttcctgtaaggaaaaggaccttgcaaattgaacccatgtactgatggtcatttctgaacttcgcacatgaggtcagtacggtcagtccatgtcgtagtaattccgaaggaaactgcacatgaatgactcatgtatgatgtatattagtaaaatgctgccatgatgtgaaccagcaatacgatagcatgtgcgacgatgttgtacaaaacagaggaggcccttgtaaaagacagacggcattacattcaggggctaaaaacatggtaccatacaggtgagatatgatggatgaatgcgggcagcagcccactgcgactacagtatacgcactaaaacctcggcagatgcaatcagaataatacacagaaacgcagaggactatcagactatgcaccagtattctgacagagtataagcacacttttgaatatgcagcagtaaaagatgcagtgaaatcagttttaaagaagttaccagattttccagtaaagatatgagacttgtgatgaaatctggccaaatcctgtgcctttcagttggatcacaaaataccttcagccgctccatagttattcagaacaaactcgagttagatccctcgaccctctgtttcgctggaccagccaaacccatgtttccattaataagttcgatagattcggtatttcaattcagggatcagatcgccgaatccagctcgaggtatagttaggtacactgagtaggtgggaggcaccgattccgattaaatctgcagtctgggaatagaaaagatcctcattttctgtcaaaagatgcctgcccaaaatccacgaagctctaagctatcacagttcacagccttagtgcccttttcctttttttttgcacaatatttgtagaaaagaatttgggctaaaatactcagtaccttcattatgctagttgagagcaagcagatcactgccgtgacaagctggacaaaccaagatcattaaatgttggccaactactaacagtgtgatgaacatgtacacatctttgcacgcaatagcttcaatggaactgtggagcactgctcgaatgtatatatatgtgcctgaagggaactcagttc

SEQ ID NO: 52 - DNA, 3000 bp, Arabidopsis thaliana
ttctgtaataaatacgtattagaaaatgatgaagatattagatattctctcgaaatcaagtcgagggccattaaaattgatgattattagaaaaaaggttataaatacttagttggaagacctagctagctaataactaagaaaattaatagaagaaactctctcttattgatatgtcgtcgtccatgcttctatattggatatagttctcgcatatgagtaaatctactatcattaatacaaaaacaataatatcaaacgcttaattagcatttgaacaataaaaatcatttatgtattcatgcataatttagacacacacacacacgcacacgcacgaatatatacatgttgtagtacactagcacttaggtctaaattttgagaactacgcaatatgacaagtaactaaatctttgttaacctaactaatgcgttgttgttgacatagatgaggtacgaaatggttgtaatatgaattcttatacacattagtatatgtggaagccaagtagccaacgaaacacttgcatgtaaatttttttgattattctttacaagcttaaacgttttttatttaacctatagaggtaaaagaaaaacagtgattttggttttgacttatataaaccgaaactctttctatcactctatagagataaatatacaaagaaatgagtaagtttctctcactatagcattaatggagctttagatcatcataaatgcattgcaccctctctatgcgctcatcaataactccttttaaatttcttattgcaactccacctgttcttttccttcctctcttgtcctcttctccttcttcttcttcaacaacaaacttccattgttcttaatacctagctagctcttccccggtttgagattatcccaaaataacaccggttctcgggtaaccggtcggtttttccggagcaaccaacccttttacttctctttatcattgtctcagatcttctgttcttcaaaggcaaaaatgggcataaaccaaagatcattgtgaattagggtttcactgtgtctccaaaagtaagatctctattatcaaaaaagatctttctctctctacacatatatgtatgcatatgcatttgtgtgtatgtatcttaggttatgtttatagatcggatccatattgcatgttgttgagactcttagatcttctatttttttgtttatggtgttttttggttctcaagatctcgatgcctatgatttgtttttttttctagattattttagtttaatttaatttaatgttttttgtgtctttttgcggagacttatgatctaagataaataaagcgttaccaaaaactttcttggagttagcagtttcaaaaggggtttgacgaaatctacttggtggttgtgtcacaaaaaaaagaccattgacttattgtcaacgctttaattaaccctatatactatatactatttttaatcgcttttaattaatcaaccctatatatcctgtattaaactaattaaacttagcctttttcattagttttgttactggaaacggttcgtctttagtgcacaaagaccaaggtcaatttaattctttaataaattcaattgagagatcagaagcttgtgaatctggttctctctctctcttctcttactagcttttgagtcgacaaaagagagagaaaagatcattaaactcgaatccaaaacttcaaccaacaaaagggaaaaaaagaaaaaataactacaaagagatctatctttagggtttcaaaactttcttgagtttcagatcgaattgagtaagtatttatattatttaagtgttcttcttactgtatcatttctgaccatacaccaaactagggtttcttaaagatcataactctctctctctcgcttcttcctacactagatctgtccgatagatctgatgctttgagaagtcttgtgactttcaagattgatttttctttttgtttgtttgtttatatgtacacatacttggagatagatatactctcatatatgttactgtgcatatggatggatccatcttaagtgtgaataaaaactacccaaatctcatttttgtttgtttcttatctcatttgttgtttttgtaaggccgtcattataaatctaaaacaatttatccgttttcgtaaagaaaatcgctttccaaaaaaaaaaactttgaagtaaaaatatcattttgggtctatattcaaatctctcctcatatttccatctcattatttgtaaaattaatatattaggtcattatcatattgattatagagtttatatgttatgttataaagtaaaagttatatatgtaaatattacgtttgtaatatatatatttatacatatgtacgtatacataatttgtatgtatatgtgcctcatttttaacaaatattatcgttaatctttagtttcattataattttttagggatgtatacattatataaatattttatgttatttatatctgaaatttctatactataacatcttagatagttttcatacgtaattaagagttttaattaatagttacataattatgattagatgaatttatctataaattgtatgcaaaaatatatacatatccaaccgaaaaaatggagagtaaacaaaaacctaacaattaatggtttagtacttgtgaaaatgataaaattattaatttaatatatagtttcataacagctagaaataactttcccttaatataattattttcttccatttccataatgattttcttcttcttcattctgtatacatatatgagcgtttcatatataatcttttactaattcgattgtgattttgattttgggcagtggaagatatacttggagaagaaaatcaaatcacgaaaatatattgatcagtgccttgaaggaaaccaaagttgacaactccaaaaatccatttcgttattaatatctaactgagtgatcatagtcaatcatccataaca

SEQ ID NO: 53 - DNA, 6237 bp, Glycine max
taatattattatcagtggagtcacgtaggaaaatgaaagtagaaaaagtgtttgcggagaagaagaacataatgttgtgaaaaattaggattaataatttttttatttaattttttaataactaatgattttgattaatttataattaacttaataactcaattaattataagtatttattaataatctatcagaatgatcaaaatcactaatttataagatttgaggatcaaatgttataattaaaattcaggagacaacaatcataaatttgagaaactagatgactaaaaattacaattaaaatttaggaattaaaatcatggatttgaaaaattaggatgaccaaaattataatttaaccttcttttataagaagaaatttaaaagtctccttgcattaaatatttttttgaaaacattattaattatgaaccatttttctgaaattaggatgaccaataggtagaatattaatatttttttccttttcatatgtagagaatttacagaaatcttattgtgtactatctttacatctataaacaataaaaggtagagcaataaacatatttacagattaattaaacgacataaagacaacaaatatactaaacaaaaagaataaggacatgtttcattactattataggtaattttgaaaataatatataaatttagaataaatatataattattaatttaattaattatttttttaatctttatgaattagttgattgaattttataaaaagatcaaaagggagcggttaatttgtagatgacttgttattcatgagaaactaaagaaaaataagaattaatgatataaatattaatcattcaattcatcttgtatttactaaatcaatcaacaaattaatttaaatcagaaatctgatgttaattaaaatgacattattttctaaaatattgttaaatccttttactattaatgaattatataagaatcaaatttaaataaatataattattgtttagtgactaattttatcttataaaatgagtttaatatttatacactcatagtatacaagagttttacattatcatccaatcatgaattccgtttgaattactttaaaataattatttgaaaagtcaataaatttaatatatatgatgagtttaattaaatgaatatataaaactttttgcataatatcaatatataataattttctcttataaaaatagtatgtaagataattttctctcattatgattatatactaatacatttgttaaaaaaattataataacgatatactgtatcaaaattaaactcttataaaattgttacgaaataattaaatgttaaaatagagtctttctattgtaaatatatttaaatcaatatttaacaccaataaacaataaacattttgtttataaatattttaattatggctaatgttaaccctttttattgtgatccacaaaattatattgtcatgatttttttacgctctcgtattcttttttttttttgacttaattatttttttaacccctgaatttaagtcgtgtattttttttagtctttaaaattttttaaaaaaattctctgaattttgacaaatgatttttttttgacataataaattgatattttatgtcaatttttagtactttgtgaaatttttttagtatttcgtaatagtttcaaaatgaaaatttaaaataaactaatattatgatttaatttacagaatcaatccatttttttgtcaaactcatttcaacatcttgtaaaataagtataataattaatctttactatcaaaactagttttaagcccggcttaactaattattattttagtttctaaattttggatttgtgatttttttagtccttaaaattttaaatttatttctttgtttctgaattttgataaattattctttttagtcagagccatgtaaattgatattttgtgataatttttaactacttaaatttttaataaaaaaaccatcacaaagtgttaaaaaccaccatataatacagtgttagtttataagtaagagattaaaaaataaatttgtcaaaatttaaggattaaaaaaatatttttaaattttagagattaaaaaaatacactccaaattcaagaactaaagcaataattaagttttaattttttaaccaataacctaataacactcaccaattagcaagaccgtgaatacttgttaactttttaatttgaaaggcaagagtagaaggcagtgtaaggggctagggttgagaaatataagagtcacttcactggacctagctcacaaaataaaagttaaagcatggaacgatatcgcgctctaactctcttctattcatgtataaccatttaattaaatttacaccagtcatccctccataaatgcttctacaccctctgcaataacttcatgctgccaaaccctctcccacttgttctacttattcattttatctcttcctgcgtcgtttggttctatctctatttcgctttggcccacactaaactcacaacttccccatcaacaactccttcacttccctaattccccacacacattcttgtttctctgatgacccacaacacatccgtttcagtcaacaacataactaattaaggttcattccactctcaaacgcttaaggccccctcttgcatctacgcattcttaattttagctttgacttgctttgcttagcttagttaatttccgagtgagagaaaggggtaacggctacgttcccccgcattgaaattggttacttgacaagcgttatagtaatcatctgttttgtcaaacctttcacactgactcaacactctacccttattttgtcttttctgatttccctagcattgcaagttttgcgtgtaagataagagtagtaaggccaaggccagggaaagtcagcagtgtcctcttgcaaccttaacataagaatgaatctccagacaaacacttgaaagtgctcgaaatcgatcgatcagagacaaaacagcgacacgaggggcctggatgcttttattatcaatttttgctttgcgtggcggttccataaatcccaattgcaagtcccatcaaactttagagatggaaagcggttgattcattatattgcagtcgtcttcgtggttaatctatcaggtgatcacttccttaatttcttattttctctcataattaaacagaggtacaacaaattttcttttttgagtaaaacagcaagttgattaaatggaaaaactttaacattttattcattctcgatggggagaaaagtcattctggcttagaatttttttacatatatacagttgctattgttatcacatatgttcatcttaatgttttattgccaacaaagtttggtattttagcaatctacaagtatttctgaaaatgtttttttaggtgtgtcatggctttggttgaagctcaccttatttaaatttttttttttgaaaataatctacgtttcatctcgactaaaaataatcacacattaaaatatataagtgagagagacaattcttattccttaagttaatttttaggattaagttagacttctcacattctaagatcttattaatgtgagagacaactctcattctctcacttactttattgtaagaattttattctttctttatttttatgataagaaagtgttaatttttaatgtttattttagagagaaaaaaagtttctattgtgaggcccaggagaaaaataaattccttacctccccaaattggcatgaaatgggtgaggggaaaaatgatctcttactaatttttattttagttttcttaatatatatatctttaaaaatagttaaatataaaacaattttatttttaaagataagtatatttttctattagaatgaaaaatataactttttataaggtgtttggctatttggtgtttccataagcatcgagaataacttaaactctttatcctttttctaaatatgcaaattaaatcaaactcaaggatcatcctataccttttttagttagcatgttattggtataaaatatctacttgttttaccaataatcaattttcatccacaaatcttaaatctaagactttatttatttaaaggaattgagtcaaatataacttcgaccaacatcttggaaatatttatttatttatctaagtaattacaagaaaaaaattctctgcgtttttgttatttccatttatcaaaataacgcatctttgctactctattaatttttttttctttttttctttcttattttttctgtattttatttctaaatcaaatagaacattaatatgtttctatctaatcttttgttacccataataatcataaacttaaaaaaatttctgtgtaaactaaacttgtagttttaaaacaaaaaataaattccatttgtctactcaattaataaataattctaaattatttaatattctctcagtgtttatattttaacatctttaaatatcaaacactctattaacactcttaatttatctctatcattcttttagtatctcattgtctatcatatcgatgtttctctctcttttatttccatctctcaagatatcaattaaatttgggtgtttgaagactttttaccatattaattttcctactttctttttattttttcatcttgctcaatcattcgacttaactgacttgactactttctttttatatggtgagtatttaatgtgttttatattttaaaaacattaaatattttatatttatttttcatttaatacttttttcgtatggtaataatattcttttcatttaatactttttttgtacggtaacacttttttcaatttcaaccaatacaccttcacgtaaaaatattaaaaaaacaattaatttgataaataatttagaaaaagatattagttaaaaaatacatgtaatacttttaatcaataccgattatattttgtctttatactaattaatcaataccgattatatttcctctttaagtctttcactataaattgaattcgagtaatgttgtatgagaaatgcaaggaagacattttttaacaaactcttgatgatttccttaaaaaaaatacttcttttataattgattgaaatttataggaaatcataattttttggaatgctaggaacattctctttggcacactcctttaaagattctttgtatatacgattgactaaagtttattgaacaattttgataggttttaatttttatttaatataaatcaggagagagtatgaaaaataaaatgtaataaaaatgatgattttcattaaattctaaggaaatattaaaaaaaaaagcgttaaagaaagtgatgttaacatttatggtattcactaccaagcacattaattagtaatctttttaatttgagttgtgatagttgttttatccttgtaaaaaaaattctccaataaaaagtattagtatttattttttatataagattcaatttataattttttattttgattatttttaaattaaattgcctctaaataagttattatattggaaaaattaattgagatgagagaatttattatatgtcagaaatacaaatgtatttaatatttacttctacaaaaaataatttaaatacttaattgaatatgttttttaggtacatccttaattgaatatgtttaaaaatttctaagaaatttgagggtaatagttaataagatgcatagttttctttttattattactgatagttattaagtaaaaatatctatatttttcatatttttagatgctaaaagtattggattcttaatatttattattttaatacaatttaaaaatttatagaaagttaatattagaaaaatataattaatttaaaattaagaatagcattgctcatttactattttactaaaaatataaaatattatctgtcaagaaaatattaaatattaactatttaccttaggtagttatgaacattcaatgtattaaacttctaacgtatattatattgattattgaagttgttcaaaaaatattcttaagggcactcgctatagggctacacaaactagcctacttcttgctttcccacatttttgcttccgtcgggcgagttaaatgttttagaattcctggtttggcagagactagctagagaagaaaattgcggcttccgaattatttaagga

SEQ ID NO: 54 - DNA, 6192 bp, Glycine max
taatattattatcagtggagtcacgtaggaaaatgaaagtagaaaaagtgtttgcggagaagaagaacataatgttgtgaaaaattaggattaataatttttttatttaattttttaataactaatgattttgattaatttataattaacttaataactcaattaattataagtatttattaataatctatcagaatgatcaaaatcactaatttataagatttgaggatcaaatgttataattaaaattcaggagacaacaatcataaatttgagaaactagatgactaaaaattacaattaaaatttaggaattaaaatcatggatttgaaaaattaggatgaccaaaattataatttaaccttcttttataagaagaaatttaaaagtctccttgcattaaatatttttttgaaaacattattaattatgaaccatttttctgaaattaggatgaccaataggtagaatattaatatttttttccttttcatatgtagagaatttacagaaatcttattgtgtactatctttacatctataaacaataaaaggtagagcaataaacatatttacagattaattaaacgacataaagacaacaaatatactaaacaaaaagaataaggacatgtttcattactattataggtaattttgaaaataatatataaatttagaataaatatataattattaatttaattaattatttttttaatctttatgaattagttgattgaattttataaaaagatcaaaagggagcggttaatttgtagatgacttgttattcatgagaaactaaagaaaaataagaattaatgatataaatattaatcattcaattcatcttgtatttactaaatcaatcaacaaattaatttaaatcagaaatctgatgttaattaaaatgacattattttctaaaatattgttaaatccttttactattaatgaattatataagaatcaaatttaaataaatataattattgtttagtgactaattttatcttataaaatgagtttaatatttatacactcatagtatacaagagttttacattatcatccaatcatgaattccgtttgaattactttaaaataattatttgaaaagtcaataaatttaatatatatgatgagtttaattaaatgaatatataaaactttttgcataatatcaatatataataattttctcttataaaaatagtatgtaagataattttctctcattatgattatatactaatacatttgttaaaaaaattataataacgatatactgtatcaaaattaaactcttataaaattgttacgaaataattaaatgttaaaatagagtctttctattgtaaatatatttaaatcaatatttaacaccaataaacaataaacattttgtttataaatattttaattatggctaatgttaaccctttttattgtgatccacaaaattatattgtcatgatttttttacgctctcgtattcttttttttttttgacttaattatttttttaacccctgaatttaagtcgtgtattttttttagtctttaaaattttttaaaaaaattctctgaattttgacaaatgatttttttttgacataataaattgatattttatgtcaatttttagtactttgtgaaatttttttagtatttcgtaatagtttcaaaatgaaaatttaaaataaactaatattatgatttaatttacagaatcaatccatttttttgtcaaactcatttcaacatcttgtaaaataagtataataattaatctttactatcaaaactagttttaagcccggcttaactaattattattttagtttctaaattttggatttgtgatttttttagtccttaaaattttaaatttatttctttgtttctgaattttgataaattattctttttagtcagagccatgtaaattgatattttgtgataatttttaactacttaaatttttaataaaaaaaccatcacaaagtgttaaaaaccaccatataatacagtgttagtttataagtaagagattaaaaaataaatttgtcaaaatttaaggattaaaaaaatatttttaaattttagagattaaaaaaatacactccaaattcaagaactaaagcaataattaagttttaattttttaaccaataacctaataacactcaccaattagcaagaccgtgaatacttgttaactttttaatttgaaaggcaagagtagaaggcagtgtaaggggctagggttgagaaatataagagtcacttcactggacctagctcacaaaataaaagttaaagcatggaacgatatcgcgctctaactctcttctattcatgtataaccatttaattaaatttacaccagtcatccctccataaatgcttctacaccctctgcaataacttcatgctgccaaaccctctcccacttgttctacttattcattttatctcttcctgcgtcgtttggttctatctctatttcgctttggcccacactaaactcacaacttccccatcaacaactccttcacttccctaattccccacacacattcttgtttctctgatgacccacaacacatccgtttcagtcaacaacataactaattaaggttcattccactctcaaacgcttaaggccccctcttgcatctacgcattcttaattttagctttgacttgctttgcttagcttagttaatttccgagtgagagaaaggggtaacggctacgttcccccgcattgaaattggttacttgacaagcgttatagtaatcatctgttttgtcaaacctttcacactgactcaacactctacccttattttgtcttttctgatttccctagcattgcaagttttgcgtgtaagataagagtagtaaggccaaggccagggaaagtcagcagtgtcctcttgcaaccttaacataagaatgaatctccagacaaacacttgaaagtgctcgaaatcgatcgatcagagacaaaacagcgacacgaggggcctggatgcttttattatcaatttttgctttgcgtggcggttccataaatcccaattgcaagtcccatcaaactttagagatggaaagcggttgattcattatattgcagtcgtcttcgtggttaatctatcaggtgatcacttccttaatttcttattttctctcataattaaacagaggtacaacaaattttcttttttgagtaaaacagcaagttgattaaatggaaaaactttaacattttattcattctcgatggggagaaaagtcattctggcttagaatttttttacatatatacagttgctattgttatcacatatgttcatcttaatgttttattgccaacaaagtttggtattttagcaatctacaagtatttctgaaaatgtttttttaggtgtgtcatggctttggttgaagctcaccttatttaaatttttttttttgaaaataatctacgtttcatctcgactaaaaataatcacacattaaaatatataagtgagagagacaattcttattccttaagttaatttttaggattaagttagacttctcacattctaagatcttattaatgtgagagacaactctcattctctcacttactttattgtaagaattttattctttctttatttttatgataagaaagtgttaatttttaatgtttattttagagagaaaaaaagtttctattgtgaggcccaggagaaaaataaattccttacctccccaaattggcatgaaatgggtgaggggaaaaatgatctcttactaatttttattttagttttcttaatatatatatctttaaaaatagttaaatataaaacaattttatttttaaagataagtatatttttctattagaatgaaaaatataactttttataaggtgtttggctatttggtgtttccataagcatcgagaataacttaaactctttatcctttttctaaatatgcaaattaaatcaaactcaaggatcatcctataccttttttagttagcatgttattggtataaaatatctacttgttttaccaataatcaattttcatccacaaatcttaaatctaagactttatttatttaaaggaattgagtcaaatataacttcgaccaacatcttggaaatatttatttatttatctaagtaattacaagaaaaaaattctctgcgtttttgttatttccatttatcaaaataacgcatctttgctactctattaatttttttttctttttttctttcttattttttctgtattttatttctaaatcaaatagaacattaatatgtttctatctaatcttttgttacccataataatcataaacttaaaaaaatttctgtgtaaactaaacttgtagttttaaaacaaaaaataaattccatttgtctactcaattaataaataattctaaattatttaatattctctcagtgtttatattttaacatctttaaatatcaaacactctattaacactcttaatttatctctatcattcttttagtatctcattgtctatcatatcgatgtttctctctcttttatttccatctctcaagatatcaattaaatttgggtgtttgaagactttttaccatattaattttcctactttctttttattttttcatcttgctcaatcattcgacttaactgacttgactactttctttttatatggtgagtatttaatgtgttttatattttaaaaacattaaatattttatatttatttttcatttaatacttttttcgtatggtaataatattcttttcatttaatactttttttgtacggtaacacttttttcaatttcaaccaatacaccttcacgtaaaaatattaaaaaaacaattaatttgataaataatttagaaaaagatattagttaaaaaatacatgtaatacttttaatcaataccgattatattttgtctttatactaattaatcaataccgattatatttcctctttaagtctttcactataaattgaattcgagtaatgttgtatgagaaatgcaaggaagacattttttaacaaactcttgatgatttccttaaaaaaaatacttcttttataattgattgaaatttataggaaatcataattttttggaatgctaggaacattctctttggcacactcctttaaagattctttgtatatacgattgactaaagtttattgaacaattttgataggttttaatttttatttaatataaatcaggagagagtatgaaaaataaaatgtaataaaaatgatgattttcattaaattctaaggaaatattaaaaaaaaaagcgttaaagaaagtgatgttaacatttatggtattcactaccaagcacattaattagtaatctttttaatttgagttgtgatagttgttttatccttgtaaaaaaaattctccaataaaaagtattagtatttattttttatataagattcaatttataattttttattttgattatttttaaattaaattgcctctaaataagttattatattggaaaaattaattgagatgagagaatttattatatgtcagaaatacaaatgtatttaatatttacttctacaaaaaataatttaaatacttaattgaatatgttttttaggtacatccttaattgaatatgtttaaaaatttctaagaaatttgagggtaatagttaataagatgcatagttttctttttattattactgatagttattaagtaaaaatatctatatttttcatatttttagatgctaaaagtattggattcttaatatttattattttaatacaatttaaaaatttatagaaagttaatattagaaaaatataattaatttaaaattaagaatagcattgctcatttactattttactaaaaatataaaatattatctgtcaagaaaatattaaatattaactatttaccttaggtagttatgaacattcaatgtattaaacttctaacgtatattatattgattattgaagttgttcaaaaaatattcttaagggcactcgctatagggctacacaaactagcctacttcttgctttcccacatttttgcttccgtcgggcgagttaaatgttttagaattcctggtttggcag

SEQ ID NO: 55 - DNA, 1999 bp, Zea mays
tcggcctgtccattattgtaggaatagctagccgcccatgcaagttctattcagcctgccttttcatcgctctgaccaccatgtcctcatctgcgtgagatgtgctatcaatagttggacacaattcgtcctcaagctacgacggggacagtttgacattaccagagagagagagagagagagagagagatagagtgctagcaataggaggggatgcaaaaacatgtaccacctcaccgttctgtcgtacttccctctgatcaacttcacaacgttcaaatttaggcaaggcgctgtggctgaagtttacaatattctgcaccacctcactgtcttttgtagttccttctgatcagctttaagttgttccaattcaggcaaggcgctgtgggttaagttgacaattgttacctcagcttgatcaacagatgacactttttttttttggtgaagaagtgttggcttccgggtcacaagagtatcctctcctctgtactgtttctgaaacttgttgccttcctgtccattgtggcgattaggccggggttaaaaattcccagtttcgataacgattgctcgttgctgggttagactttgcacagaaatcttccgctcgaggagggggtttagttattaattacccacagtgatgagagtgacgtacgctgtactagaatttttgcgaatgactgacagtaatgacatcatcgtccctgacaataatatccaacatccaacgcccccacacttatattccagtccaggcatattgtatatgaacgagcgagcacgcacggtacgtacgtgtgcggtgtgtccgccggcgcctaccaggacgtagtacaacatcgccatctgagcccatgacgcccgcccagcgccagcgccagcggcacggcaaaagtcgccggcgccagcaagaacagcaggaagcacaggtttcaaagggggcgccgcgagccagggcccaggaccagcagcacgtacagagcgggagtaataaacgctgaaaagctccgcgccctctcgcgcaatcaatggcgacgcgacgcgaactctaccggccggctccgtccgccccagtcggggtccccacgcccccagggggagggtgcctctctcgctcactcacccgtcgccctgcgtgccgaattaatggcggcgaccgctgcgtgcaactgatccgacccgacccgaccagaccccccgcgccgacgaccgcctagctctgcactcaccgggaatcagagaccgaggcgccgcgagtagcagaggcaaccacccgttctttggagtcggagcgtcccggcccggtcgggatccattttctgcacgtcgtcaccactcaccacgcgcattggaaccgccggaagccgcgcgtgtgaaaaagctgctgcttcatggtcatggtcatggcggtcacacagcagcttaatttgttacgctaagtcgctaacagttgagacactggcacaagcagcatggccggcctccggctctcatgagactacttgcctcctgtgccagtgccagccagtatagaaattgagacgacgacgtcgacggcaacaacagccgtcaccaccacgccgcgtctcaatcccgttgggtttcaggcgccataactccagcagtcccgctgcgagtgagggggagccggtggcacggctgggctgcaacgatccgtgtccccccgcgtcctcctccttcctactgtgcggtgccggtgccgctgcccccaattgctcgcgttgcttgcgtcccttggcgaccaagttacatgtataaagccatgcatgaccagagaagaacacacaactgtcctggcctgtccacggtccacacacgccttccttatatcggcgctcacggttctataaaaaaaacacagtacgagcagagcaaggcggccgtgagctgagctgagggaaggacgacgtacggctcagttgctagcccggccgccggagctctccgagatctgggccgccagcaacac

SEQ ID NO: 56 - DNA, 3000 bp, Arabidopsis thaliana
attttaagaaattaaatctttttttttggtatctgtgtgttactttttataaatgtattttgaaaagtattatttcaatttatagataaatataattatgactctcaagtggatttttttttcacggtcaattggagtttggctgtgaatcttgtgaataatatcaactaattaagagtcggccgatactccgtatctttgatcactttcacccatatcttgaaatttaccaaatgttttctttcattggggtttctataccttttttttttggttctttctgtaatttgggttttaaagaaaaaacctataattacaaaaaaggttaaaagttaaaactaagcacgttcaaatatgttctttcgagatcccaccttcctgtctatcttataagaagtcgaacacgtgtgctcgttgtgtgaattagagtggttatttcaacatatataattaaactatgtatgtatcataaatacactgaatatgttggagttgggtcttgtggtaggctaacttgttcgcttcactttggtttagtttagccttgtaatcggtggtttcatatactgaaatttttaattttctaatataatccagatgacaaaaaaaaatcataaatacactgcaatggccatttttaaaaaaactttaaacgaaatatatatacatcaccaagtatcaagtaagtaatttggttgttttgatttttcaaaaaaacatttaggtgattcttttaacaaccaatcatatatgtagcaaagattaattatgtcaatcttttaacgtcacttatatagtttagctgtagtattattgtaagccaattgtacggacttcgtaaccgtttcgacaaagatacaaactaatcaatgtttaagatggcataatattccgacttcccctgccactcggtagtactgctgcgccatcctacaagaagcactcgtaaatgagtggttagacggccaaaaattagcaggattcaatccttgattaagagatggttcagataagccctctaggcctctactcgtcacaattcatatattaattgatcacactgcatgaaatgataagatcaagtcaattacctcaaaattaattgaaagataaaatgataaagcaacaagtaatgatcatatatggatgtaacaaccttcttcatccatacgaatatgataattcttttgtcgatcatttgccacatctatttaactaagtattttgtacattaagatcattttgcgagtattcccgcgttcccaacaaaaacgaattgaaaaactacatagggtgaattttgctctcgtggcattaaagagagaggctgacattatagattatgatatatttattatttttcttagtagatttcttgaccagcctttagatatgcttgctctgtcatggcataaagccttaaaccctaaagccctttacatttgtacagtaccaacaattgtacccaatgttaaatgaatgcggattaatttgtgatatgagaccatcaaaataaaatacttataagatagtagatatatagaaccgtaacaaaaagatgagaagaaaaagacaaattgaatagaaactggaccaaaagataaaagagtatatgaagaagcaagccaccaagaagtgtaaccatcgttgcttcaactgtaaaccgcacattaaatgtgtgtgagagaaagagagatagactccagctgtgagagctacgtccattgcatcaattgggttatatgtcgttaacaattttttaaaaatacataaataaatcaataaaatatttagaaaaaatcaatattataatgatattttgaagaagttaggtccataatggaaatatagagacttagtgtctatttatcaagaaatagtgtctatttatcaagaaataatgtctatttggtccacaattatcatattttttgtggccactcaaactacgaaaataatgaatattgttaatttttgtcttatttaagtctataactaacttactaattcggttgaaattgctaatatgcattttccttggtccactattacagtgctactgctgtcttattcttgaacacaaaataaaaaagatttcaaacacaaaatatgcatttttttgttccaccattacaaacctttatttggagaagtatacagttggatattaaatattttaattaaaaaattgaaaatattgaagttctttttctccagtattttggctggagcaaaactaaataaattccaaattaaaagctcgaacggaaaacatttactatgcaccaaaataaatgttgatatgaaatttgcatcagcatatacagtatgtatgtagtacaattgaacagagtcaaaattaattgtcactgaaacagtcagattttatttctgttaaaaaatattttcagacaaaaaatgattttttaacgtttttttatataattttattaaacctcaaaacattcctcagcagattgttttataatgttattattattttttcttaaataattttatttgaatttcgttatagagagataaataaaagatttttggggtctagttggctctcatagtttgaatgcttatataaggaaacagagctcgaggctctcaataatgccacataaaacacaacaccaaagcctttataactctttctggggtttttaattctctcaacgaacaaaaaaaaaaactcaactaatattctccatcctctttcttcagatttaagagaaaccttatcgttatattctctcttctcttttctttttgactcccacaagaagaaagcaaatttctttttctcaggattgcttgaaaactgtagaaatctttaaggtttttttacaccaataagagtcagagagagagagagagagagaaagagagatctattcataaaaaagacaggtaatctcaactccgaggagataactgatataacaatttgagagaataagaagaagaagaagaagaagaccaagctaaaga

SEQ ID NO: 57 - DNA, 2620 bp, Arabidopsis thaliana
attttaagaaattaaatctttttttttggtatctgtgtgttactttttataaatgtattttgaaaagtattatttcaatttatagataaatataattatgactctcaagtggatttttttttcacggtcaattggagtttggctgtgaatcttgtgaataatatcaactaattaagagtcggccgatactccgtatctttgatcactttcacccatatcttgaaatttaccaaatgttttctttcattggggtttctataccttttttttttggttctttctgtaatttgggttttaaagaaaaaacctataattacaaaaaaggttaaaagttaaaactaagcacgttcaaatatgttctttcgagatcccaccttcctgtctatcttataagaagtcgaacacgtgtgctcgttgtgtgaattagagtggttatttcaacatatataattaaactatgtatgtatcataaatacactgaatatgttggagttgggtcttgtggtaggctaacttgttcgcttcactttggtttagtttagccttgtaatcggtggtttcatatactgaaatttttaattttctaatataatccagatgacaaaaaaaaatcataaatacactgcaatggccatttttaaaaaaactttaaacgaaatatatatacatcaccaagtatcaagtaagtaatttggttgttttgatttttcaaaaaaacatttaggtgattcttttaacaaccaatcatatatgtagcaaagattaattatgtcaatcttttaacgtcacttatatagtttagctgtagtattattgtaagccaattgtacggacttcgtaaccgtttcgacaaagatacaaactaatcaatgtttaagatggcataatattccgacttcccctgccactcggtagtactgctgcgccatcctacaagaagcactcgtaaatgagtggttagacggccaaaaattagcaggattcaatccttgattaagagatggttcagataagccctctaggcctctactcgtcacaattcatatattaattgatcacactgcatgaaatgataagatcaagtcaattacctcaaaattaattgaaagataaaatgataaagcaacaagtaatgatcatatatggatgtaacaaccttcttcatccatacgaatatgataattcttttgtcgatcatttgccacatctatttaactaagtattttgtacattaagatcattttgcgagtattcccgcgttcccaacaaaaacgaattgaaaaactacatagggtgaattttgctctcgtggcattaaagagagaggctgacattatagattatgatatatttattatttttcttagtagatttcttgaccagcctttagatatgcttgctctgtcatggcataaagccttaaaccctaaagccctttacatttgtacagtaccaacaattgtacccaatgttaaatgaatgcggattaatttgtgatatgagaccatcaaaataaaatacttataagatagtagatatatagaaccgtaacaaaaagatgagaagaaaaagacaaattgaatagaaactggaccaaaagataaaagagtatatgaagaagcaagccaccaagaagtgtaaccatcgttgcttcaactgtaaaccgcacattaaatgtgtgtgagagaaagagagatagactccagctgtgagagctacgtccattgcatcaattgggttatatgtcgttaacaattttttaaaaatacataaataaatcaataaaatatttagaaaaaatcaatattataatgatattttgaagaagttaggtccataatggaaatatagagacttagtgtctatttatcaagaaatagtgtctatttatcaagaaataatgtctatttggtccacaattatcatattttttgtggccactcaaactacgaaaataatgaatattgttaatttttgtcttatttaagtctataactaacttactaattcggttgaaattgctaatatgcattttccttggtccactattacagtgctactgctgtcttattcttgaacacaaaataaaaaagatttcaaacacaaaatatgcatttttttgttccaccattacaaacctttatttggagaagtatacagttggatattaaatattttaattaaaaaattgaaaatattgaagttctttttctccagtattttggctggagcaaaactaaataaattccaaattaaaagctcgaacggaaaacatttactatgcaccaaaataaatgttgatatgaaatttgcatcagcatatacagtatgtatgtagtacaattgaacagagtcaaaattaattgtcactgaaacagtcagattttatttctgttaaaaaatattttcagacaaaaaatgattttttaacgtttttttatataattttattaaacctcaaaacattcctcagcagattgttttataatgttattattattttttcttaaataattttatttgaatttcgttatagagagataaataaaagatttttggggtctagttggctctcatagtttgaatgcttatataaggaaacagagctcgaggctctcaa

SEQ ID NO: 58 - DNA, 2792 bp, Glycine max
ttaaaaaaaatctcaaaagaataaattttcgactaccagtaattggattttaaataggaagagattaaaaaaccacctcttaatcttatattccatcttccattccataagattgtgggtgtcattaaaacttattatcaatacaaaatgaaaaataaagagtcacggtttgttgaggagaagaatgcacttagttccaaatcccaatacatgtattaagtagtttcgttaacttttttttattaaattttaattatgttcaattaattatcaatttctataattaatttattattttaccccgaatttgagggggaaaaagttaaacttataagatactttccatgttttttaaaaattgcattcaatatttttcttttttttttcaccctaaaaaaatattttaattagttaactcacattacactcagatccccttaacagaaggtccatgttgatcacattatttttaataaaaaattatgtctaaaataccctcaaataaattacacttgcacttccatgtgtttttttaaaattacatctaatattcctccttttttgtacactataaaaaatctcttaattatttagctcccattacattcactaagacttcttccctctcctaaacacagtttaataatttaatagaaagtagacacaatttgatcatatgacttttaatgaaaatttatatctaaaatattcttatcttcttcctcttaacttcataaaaaacataacattattttgaacctgaaaatattttaatacttttttttctctaattgaacctgaactcaccttgttggtacgtatgtgttaatatctttccttttttttttttacttcaattttttttgtgtgttgagttgtttggttgcaacatttttgttggacatgttcccaacaatgccaattgattgaatatgatcatttgcttcaaattttaatgttttgttcatgcatttgtgttttaactcctttctttgaaatatttatttttgatgactagttgcttgatataatgtctcaatcaagagtttatatcttcttcgagtaatagcaacaacgaagtaaaaataaaatattaaaggaaaattgttattgtcttaagaaaaattcattaacagagtcaattgttaatttgttattgagtatttaacaaagatgttaggacaatttcatctgctcatatattccaattgatgttaattaacgacgttaacggaaagagataaaaataatgtaaaaaaaggaaggtatatcagatgcaatttgagaaaaacacaagaaatacgattataacaaaaatgttaaaacaattttatctgttcacatatttcaattaacgtaacaacgttaataaaaaagggataaaagtaatataaaaaagagaagtatcaagtgtaatttgaaaaataaaaaaacacaagaaatacgagtagtgtaattttttttagattaaattaaataataaagtctttgttaaattaaacataaggttactttataatgctctcataatgaaaaccggatttagaggtaactccaaacctaccttatctaacagctgagaggtactgtttcacctgccaaccatataaggcatttactactactctccagatctcttactgctggattacaacacgctacagcaacacgacgcgcggggtgtgtgttttcgtttacgtagattttaattttttaaggctctaattataattaattacagcgtaattaatatggagtactataaagtataataattataataagccatgtatataaaaaggagaagtgtatctgttaatgtgtactaatatcttacacaaaagtatctgataggagtgctcgtgaaatgaaataaaatgatgttattaccagaataacaaatatagaatttagctaacatatatagttaggttaaaatgtttttatataaatatttaatagaaaattacattctccttacattatagttagcattaacgattaagatgatataataaaatgatcaaatcttattaaatatctgtctaaaaataacttaaactaatataatcggtatataaacttaactcttaaatacaacagtgattaaaataaaatcaactttatcaattattatatttaaaaaattaaatagaaataattttatgaaaaaaattactataaaatgcattgataatattgaatactaataatttttaatagtttgtttttagaccaccaaaccagaatcaatcaagggagggttatttcagcttaactaagtttttatatattattttatttatttcataagattaaaatctcaagtgagatacatgaatcaaatagtagtacttttttttagaatatattaattgataatttaatgtcccagttagcagaagacaggtgggagactatcttactttgtaggccacaaggatcaatgcatgatccgcagcgcttataaatacgtgatgggacgaaagaatatatttttaagttgtggctcaaaagcaattactactaagaaaggataaaggaaggaaggaacacttttctgatattctttttggtattgggttgctgacctttgctagtgttatagattttttgggttctcttgtgttttaataaatacaggaaaaaaaaagtatataggtgcctagaagaaaagacaatatagggtgtggagcaattacgtttgatcacaagggaaaaggtgcaacggtttgcaagatagcatagaagattttgaagaatcttaattgcaacatagtagtgcagttgca

SEQ ID NO: 59 - DNA, 2500 bp, Glycine max
ttaaaaaaaatctcaaaagaataaattttcgactaccagtaattggattttaaataggaagagattaaaaaaccacctcttaatcttatattccatcttccattccataagattgtgggtgtcattaaaacttattatcaatacaaaatgaaaaataaagagtcacggtttgttgaggagaagaatgcacttagttccaaatcccaatacatgtattaagtagtttcgttaacttttttttattaaattttaattatgttcaattaattatcaatttctataattaatttattattttaccccgaatttgagggggaaaaagttaaacttataagatactttccatgttttttaaaaattgcattcaatatttttcttttttttttcaccctaaaaaaatattttaattagttaactcacattacactcagatccccttaacagaaggtccatgttgatcacattatttttaataaaaaattatgtctaaaataccctcaaataaattacacttgcacttccatgtgtttttttaaaattacatctaatattcctccttttttgtacactataaaaaatctcttaattatttagctcccattacattcactaagacttcttccctctcctaaacacagtttaataatttaatagaaagtagacacaatttgatcatatgacttttaatgaaaatttatatctaaaatattcttatcttcttcctcttaacttcataaaaaacataacattattttgaacctgaaaatattttaatacttttttttctctaattgaacctgaactcaccttgttggtacgtatgtgttaatatctttccttttttttttttacttcaattttttttgtgtgttgagttgtttggttgcaacatttttgttggacatgttcccaacaatgccaattgattgaatatgatcatttgcttcaaattttaatgttttgttcatgcatttgtgttttaactcctttctttgaaatatttatttttgatgactagttgcttgatataatgtctcaatcaagagtttatatcttcttcgagtaatagcaacaacgaagtaaaaataaaatattaaaggaaaattgttattgtcttaagaaaaattcattaacagagtcaattgttaatttgttattgagtatttaacaaagatgttaggacaatttcatctgctcatatattccaattgatgttaattaacgacgttaacggaaagagataaaaataatgtaaaaaaaggaaggtatatcagatgcaatttgagaaaaacacaagaaatacgattataacaaaaatgttaaaacaattttatctgttcacatatttcaattaacgtaacaacgttaataaaaaagggataaaagtaatataaaaaagagaagtatcaagtgtaatttgaaaaataaaaaaacacaagaaatacgagtagtgtaattttttttagattaaattaaataataaagtctttgttaaattaaacataaggttactttataatgctctcataatgaaaaccggatttagaggtaactccaaacctaccttatctaacagctgagaggtactgtttcacctgccaaccatataaggcatttactactactctccagatctcttactgctggattacaacacgctacagcaacacgacgcgcggggtgtgtgttttcgtttacgtagattttaattttttaaggctctaattataattaattacagcgtaattaatatggagtactataaagtataataattataataagccatgtatataaaaaggagaagtgtatctgttaatgtgtactaatatcttacacaaaagtatctgataggagtgctcgtgaaatgaaataaaatgatgttattaccagaataacaaatatagaatttagctaacatatatagttaggttaaaatgtttttatataaatatttaatagaaaattacattctccttacattatagttagcattaacgattaagatgatataataaaatgatcaaatcttattaaatatctgtctaaaaataacttaaactaatataatcggtatataaacttaactcttaaatacaacagtgattaaaataaaatcaactttatcaattattatatttaaaaaattaaatagaaataattttatgaaaaaaattactataaaatgcattgataatattgaatactaataatttttaatagtttgtttttagaccaccaaaccagaatcaatcaagggagggttatttcagcttaactaagtttttatatattattttatttatttcataagattaaaatctcaagtgagatacatgaatcaaatagtagtacttttttttagaatatattaattgataatttaatgtcccagttagcagaagacaggtgggagactatcttactttgtaggccacaaggatcaatgcatgatccgcagcgcttataaatacgtgatgggacgaaagaatatattttt

SEQ ID NO: 60 - DNA, 2691 bp, Oryza sativa
tgccggttcggcggaagaaacaccgaccaaattttattaagattgaaagaagttacatgcatccgacattagaccgtcgagttaaggcgagaagacctaagaagcaaaacaaaagaaaaactgagagaagaatgtaaagggcaagtgcacttagggctactcctcactaaaccttcttttgtggattgatgcatcaaaaaactatatgtactaggttacatcgtgttttttttttcgttttcgtctcattctctgcttcggcctgccgtctgcttataccgttaattcgatgatgactccagacttcattcatgaatatatttctactatagatatacaaccctcgctcctctatgtttatcttcatcttcatcttcaggagattcaaacaccacctcttaaagatgaagatgaagatgaagataaaaattaagtgtttcacgtaaaacgatgtattaataacatgtgattaatagagttttaattgttataaacttgaaaaatgaattagtatgatattttagagcaactttcatatataaagttttcgcacgagacgtaccgtttagcagtttgaaaagcatgtcacgagtatccaaaatttaatcttgtgcttgcagaagaaacgaagagggcctaacccatataacctgcgtcattaatctatagcttagcaaagtttacttttttgcctgcctcctggcacaggaacgccgacgaagaaaaacctacaggctttctcaactatgattccttcctcaacctgtgaactctggcgacaggaggacgacaggggtgtatgtggagcagataatgcacagtaataatccaatccttaggacttacaaactgctggaatgaactgaccaagtacgtttagaacgtaggaattttgacttatacatgcatagtgtgatttgtacgtgaaatacattaattaattttctgaatttgtttccaatttctcgtcgtcaggcaatgccgcaatgccttgtcttaaagattgcaaattgaatgcgccatctccatcgatctctctatctccattgatggctgcccaaaaaataaaaaataaaaagagccgacaatgtttaaggagagaagcatacgcgcacgtttcgtgatgaaacatacatgcaagactaatttcgaattatatatcacatattcgctctctgaatgagcgtatcgggtatttggaatttcgtttgatatgtaaaagttgaattttaggttacttttttgtggaataatatatcataaattaatattttttataactatttatgtgacatgtaaatgacgagctgatatcagtttaggataatttcctcgctaggtgattgaacgaaccctgcacgcggcagacgtcgtggctactactatctagctagctagcgttggttacgcgtggctactatccagccagaattggttacgccgtcgcccatcgatccgccacaccacgccaaacgcgaacttaattgctactatccgatagtatgtacgcgtactacacaaaagtggggaaaagaaggttgtcctgactccatgagaagacgatccaaaacacggggccggacaaccaaacaagctagctagcggccggcggcgagccaccgtcgtcgttgctgaagacgtcgactaatttggcctcccggccggcgccatcgatcatctcaaaattaatactccctctgtataagggattttgagtttttgtttgcactgtttgatcactcgttttattaaaaaaatttgtgacaatataaaaaacgagaagttgtgcttaaaatacttcggataataaagtaagtaaaaaataaataataattctaaaaaaaatttaataaaataagtgtgcaaacaatacaagcaaaaactcaaaatcacttataatcatgggacggagggagtatatagtatccaaaaatcatctcaaaattaaaaccgaatcgaaactcgccgggccgcggcccgcccggccgtcctggcccaattaattccggcgaccgctgcatgcaacgctccgtacgtgatcgcccagcggctcgcgcgcgcaccacgcgtccacgcgtctctctcctttatacatggacaatggattaatttacttgtagaaaaaaaaacacgaggctagcttagcttgtgcccggcccagccgcgtgcgtgatttccccaagttcacaacctgtacgtgtgtgtggtacgtagcggtcgcaatcccgtttcaaatctcgatcgtgtgtggtgccattaactccgtctggttggggaagccggtggcggatagcccgactgacaggtgctgtggcctggcggccggccggccaatcgatggatggacggatggatcccatcgatgatccttcgttgattcgcgtcaacctctcgctgcccgaatcggactctcaccttccccgccctccaccgctgtgaccgcgcgctgtctgtcccttggctaataccagtcgcagtgcaactgtgcaagtgtttcacgtatataaaagcatcccgagacgcagcgcgcatgaccagccgcgttgggtgcaaaaccacaaccgccaacatcttctaactcccctcacggctctccctctccccgcacgcacaacaccggtgaacccctacgtactactgagctgagctgagaggacgaagaagaagatcaagctcgaggggcttgcgatc

SEQ ID NO: 61 - DNA, 2500 bp, Oryza sativa
tgccggttcggcggaagaaacaccgaccaaattttattaagattgaaagaagttacatgcatccgacattagaccgtcgagttaaggcgagaagacctaagaagcaaaacaaaagaaaaactgagagaagaatgtaaagggcaagtgcacttagggctactcctcactaaaccttcttttgtggattgatgcatcaaaaaactatatgtactaggttacatcgtgttttttttttcgttttcgtctcattctctgcttcggcctgccgtctgcttataccgttaattcgatgatgactccagacttcattcatgaatatatttctactatagatatacaaccctcgctcctctatgtttatcttcatcttcatcttcaggagattcaaacaccacctcttaaagatgaagatgaagatgaagataaaaattaagtgtttcacgtaaaacgatgtattaataacatgtgattaatagagttttaattgttataaacttgaaaaatgaattagtatgatattttagagcaactttcatatataaagttttcgcacgagacgtaccgtttagcagtttgaaaagcatgtcacgagtatccaaaatttaatcttgtgcttgcagaagaaacgaagagggcctaacccatataacctgcgtcattaatctatagcttagcaaagtttacttttttgcctgcctcctggcacaggaacgccgacgaagaaaaacctacaggctttctcaactatgattccttcctcaacctgtgaactctggcgacaggaggacgacaggggtgtatgtggagcagataatgcacagtaataatccaatccttaggacttacaaactgctggaatgaactgaccaagtacgtttagaacgtaggaattttgacttatacatgcatagtgtgatttgtacgtgaaatacattaattaattttctgaatttgtttccaatttctcgtcgtcaggcaatgccgcaatgccttgtcttaaagattgcaaattgaatgcgccatctccatcgatctctctatctccattgatggctgcccaaaaaataaaaaataaaaagagccgacaatgtttaaggagagaagcatacgcgcacgtttcgtgatgaaacatacatgcaagactaatttcgaattatatatcacatattcgctctctgaatgagcgtatcgggtatttggaatttcgtttgatatgtaaaagttgaattttaggttacttttttgtggaataatatatcataaattaatattttttataactatttatgtgacatgtaaatgacgagctgatatcagtttaggataatttcctcgctaggtgattgaacgaaccctgcacgcggcagacgtcgtggctactactatctagctagctagcgttggttacgcgtggctactatccagccagaattggttacgccgtcgcccatcgatccgccacaccacgccaaacgcgaacttaattgctactatccgatagtatgtacgcgtactacacaaaagtggggaaaagaaggttgtcctgactccatgagaagacgatccaaaacacggggccggacaaccaaacaagctagctagcggccggcggcgagccaccgtcgtcgttgctgaagacgtcgactaatttggcctcccggccggcgccatcgatcatctcaaaattaatactccctctgtataagggattttgagtttttgtttgcactgtttgatcactcgttttattaaaaaaatttgtgacaatataaaaaacgagaagttgtgcttaaaatacttcggataataaagtaagtaaaaaataaataataattctaaaaaaaatttaataaaataagtgtgcaaacaatacaagcaaaaactcaaaatcacttataatcatgggacggagggagtatatagtatccaaaaatcatctcaaaattaaaaccgaatcgaaactcgccgggccgcggcccgcccggccgtcctggcccaattaattccggcgaccgctgcatgcaacgctccgtacgtgatcgcccagcggctcgcgcgcgcaccacgcgtccacgcgtctctctcctttatacatggacaatggattaatttacttgtagaaaaaaaaacacgaggctagcttagcttgtgcccggcccagccgcgtgcgtgatttccccaagttcacaacctgtacgtgtgtgtggtacgtagcggtcgcaatcccgtttcaaatctcgatcgtgtgtggtgccattaactccgtctggttggggaagccggtggcggatagcccgactgacaggtgctgtggcctggcggccggccggccaatcgatggatggacggatggatcccatcgatgatccttcgttgattcgcgtcaacctctcgctgcccgaatcggactctcaccttccccgccctccaccgctgtgaccgcgcgctgtctgtcccttggctaataccagtcgcagtgcaactgtgcaagtgtttcacg

SEQ ID NO: 62 - DNA, 2946 bp, Populus trichocarpa
tactgtgaaaaaataacttgtccagtttttatttcatctgcatttttcaataccaacaaaatcatcgtgaaaatatttgatctaaaaaatcattttttaccatctatttcctattagaaattccaacaccatttatttttatgatagaaaattttatttatttatttgataaaaaataatgaaagaaaatgacgaggaacttaataaaaaaatataataaaacaagaaaaaggataagatttttttaaaagaatgacaactaagattggataaaaaaataaaataaaatactgagggacaaaattgaaagaaaaaacaaattaagaaaaggataaaaaagagcaattccaaaaataaggactaaatctggaaaaaaagaaatgaaataaaatatcgagggacaaaattgaaagaaaaacaaaccaagaaaattataaaaaaaaacaacaatcaagagaatgagtaccatgtttgatataataacaaaacaaaatcaatgaaaatggatgaaaatgaagaaaaaatccaaaacaaagaaagagcaattaaaagaaagaggatcataattgaatttttttcaccattattttttttatcaaaataatataaattttactttttagttgaataaaaaatcaagttattagttaggggaaaatcatgttaacacccattgatttttatttttgccattatttttttttatcaaaataatgtcattttacttcctgcaaaataaaaaactcgattgaccctggtaaccctgatcactcgacccaacccatgactcgggagatgatgggggtcgactcctaagccgggttttaaaagcatgataaaaaaataagcactaaatatgaaatgaaaatccaataaaattaaacaatgactgatgaaattgcgaaaaaaaattaatcaataagagaactaaaaataacaggaattacaatcataagaataatgaacgaattcaacaaaaaaaagaattaaaatcaaatgataatggattaaattgaaaaataaattccaattagaaaaaaaaagattaaaagcaaaataaataggaataaaaaaatgaggatcaaatttgacaaaaaacataaaaaaatcaaatgttaagggatgaaattaaaaaataaataaatcagattcgatacaattagaaaattgagaaccattttgcaactttacaaggttaacacatcttttgatatagaggagagagaaaagaggggtggagaaaattttttgcttgaactccgctgcgccacgaatgatgacatgtgttggcccaccgtgtggagggcgacatgacacttcggatgccgttgttaaagaccactaacaaccactgggaggagcctcacgcgccactcaaaaggcgcgagcgccttccacttgctggcgagtgctctgcgcgccccaactacttttttttttgaattacagaaagatcataacattcatgaccccacatgataatttaaaaaaaatctaaaaacaccccttgaccttaaacaagaaaaagttaattccaagggttattacagagagcaaaacactcctaatcccatgtgataattgcaaaaataaacctaggtttgagaaaccaaagataccctttacccttagaaaatatttttgaccccaagagctatttggtaattagactatgaaaaaatatgaaaattaagaaatgaccattgaacataaaacctttttttttccttctaaaatcatgggcgtaattatactaagcaacaaaatgtaaaaatactattccactcttatatgtattttatattttgatatctttgaaggacaaattaatcgttttattatgaattgcactgtggacaatccacaataaaatactgataccttttagttatatgttaaacattgaagaaatgttttttcatatttttcacgatttttttatttttatatcttttagttttccaaatttaatagtaaaaattaaattgggtaaaattattagtctaaatatgatgtaaacataaacattaaaatgataaaatatttaaagagatatttatataaaaaaattaatttattgccatccctatcttttatcttctttaaccttccttgctagaaagaataaaaaaaaatagttaaaaaatattcttaaaatcaagacaaaaattaattattatttccatctccaccataaaatatatttcttattggtttatttgatattataatagcggttgtttttttataaatatattaattattttttaaaatttatttttaacattaacacatcaaaataattttaaaaaattaaaaaattaattttaaataaaaaaaccctataatagaacgtaaaaaaaacaaacacgtattttgaattaattaccaatttggcacaaaccgtgagctgaattcttcaactgcccaaccaaagagtcattaatttctaggagcatgaggccaccactccagctgtgtgccaaatgacaagggaggagaggaaatgagacaaaaacatggaagtgtgagctgctaaataaagattgattaagaacttcaactgtatttttggtccttccttcaagctatatatatgtgggtgcctccataaagatatcgcagttacgagtaatagatatacagtgttagtcgagtctttaaaggaaaaaatcaaagagagagagactgaacttgatactctcttcctttcatctctctctccccctcttaccctctaagggttgctccatctggagcttgcgttcatgttttttcgcttcatttgtggtgtagctaaccactttgagccataaccagggaactatctttttacccaacaagataaagctgcttacaggagcaaaattgagacatatactccagtaaaaactcaagaaaaaattgaagaaaaccgttgaagatcaggtgctttactgcaaaaaa

SEQ ID NO: 63 - DNA, 2500 bp, Populus trichocarpa
tactgtgaaaaaataacttgtccagtttttatttcatctgcatttttcaataccaacaaaatcatcgtgaaaatatttgatctaaaaaatcattttttaccatctatttcctattagaaattccaacaccatttatttttatgatagaaaattttatttatttatttgataaaaaataatgaaagaaaatgacgaggaacttaataaaaaaatataataaaacaagaaaaaggataagatttttttaaaagaatgacaactaagattggataaaaaaataaaataaaatactgagggacaaaattgaaagaaaaaacaaattaagaaaaggataaaaaagagcaattccaaaaataaggactaaatctggaaaaaaagaaatgaaataaaatatcgagggacaaaattgaaagaaaaacaaaccaagaaaattataaaaaaaaacaacaatcaagagaatgagtaccatgtttgatataataacaaaacaaaatcaatgaaaatggatgaaaatgaagaaaaaatccaaaacaaagaaagagcaattaaaagaaagaggatcataattgaatttttttcaccattattttttttatcaaaataatataaattttactttttagttgaataaaaaatcaagttattagttaggggaaaatcatgttaacacccattgatttttatttttgccattatttttttttatcaaaataatgtcattttacttcctgcaaaataaaaaactcgattgaccctggtaaccctgatcactcgacccaacccatgactcgggagatgatgggggtcgactcctaagccgggttttaaaagcatgataaaaaaataagcactaaatatgaaatgaaaatccaataaaattaaacaatgactgatgaaattgcgaaaaaaaattaatcaataagagaactaaaaataacaggaattacaatcataagaataatgaacgaattcaacaaaaaaaagaattaaaatcaaatgataatggattaaattgaaaaataaattccaattagaaaaaaaaagattaaaagcaaaataaataggaataaaaaaatgaggatcaaatttgacaaaaaacataaaaaaatcaaatgttaagggatgaaattaaaaaataaataaatcagattcgatacaattagaaaattgagaaccattttgcaactttacaaggttaacacatcttttgatatagaggagagagaaaagaggggtggagaaaattttttgcttgaactccgctgcgccacgaatgatgacatgtgttggcccaccgtgtggagggcgacatgacacttcggatgccgttgttaaagaccactaacaaccactgggaggagcctcacgcgccactcaaaaggcgcgagcgccttccacttgctggcgagtgctctgcgcgccccaactacttttttttttgaattacagaaagatcataacattcatgaccccacatgataatttaaaaaaaatctaaaaacaccccttgaccttaaacaagaaaaagttaattccaagggttattacagagagcaaaacactcctaatcccatgtgataattgcaaaaataaacctaggtttgagaaaccaaagataccctttacccttagaaaatatttttgaccccaagagctatttggtaattagactatgaaaaaatatgaaaattaagaaatgaccattgaacataaaacctttttttttccttctaaaatcatgggcgtaattatactaagcaacaaaatgtaaaaatactattccactcttatatgtattttatattttgatatctttgaaggacaaattaatcgttttattatgaattgcactgtggacaatccacaataaaatactgataccttttagttatatgttaaacattgaagaaatgttttttcatatttttcacgatttttttatttttatatcttttagttttccaaatttaatagtaaaaattaaattgggtaaaattattagtctaaatatgatgtaaacataaacattaaaatgataaaatatttaaagagatatttatataaaaaaattaatttattgccatccctatcttttatcttctttaaccttccttgctagaaagaataaaaaaaaatagttaaaaaatattcttaaaatcaagacaaaaattaattattatttccatctccaccataaaatatatttcttattggtttatttgatattataatagcggttgtttttttataaatatattaattattttttaaaatttatttttaacattaacacatcaaaataattttaaaaaattaaaaaattaattttaaataaaaaaaccctataatagaacgtaaaaaaaacaaacacgtattttgaattaattaccaatttggcacaaaccgtgagctgaattcttcaactgcccaaccaaagagtcattaatttctaggagcatgaggccaccactccagctgtgtgccaaatgacaagggagga

SEQ ID NO: 64 - DNA, 2817 bp, Vitus vinifera
tatattatgtaagtttgaaaaaaaggataatatttgataaggtatttaaaaattatttacttcaaaaatgcattcaacaataataatttttaaccatttatctttcatgttcaatttattggagaaaaattattggtaaatcattcaacttggtcccattaataaataggtactaataaataggtgagagaatggtgaaaaaaccaaagagagaataagaaaggtagagtgaccagagttttttcatttaatagtcagaggtattttaggaattttttgaagacaatatctttcatttcaatttctactctttcattgggttttaagtttaattataaattatatgaggaccttatctcaattattcaacccaactgggatagaaacagaattctccctatttagattagggaaaattgatttaaggttttttttttttaaatagagttaacaataaaatacaaactaacaaactttcaagagaaagaaaaaaaaaacacttataatattacaaaaaaaaaaaaaaaaaaacacatcctaatcacatagcaaaactcaatattttttctctctcttcttttgtcctattaacaaccaaacatgattcaattaattgaattaaactattaaactaataaaaagagccgatccaacttggttgttagttgttccgtattgcatttgcttttacggatgaggaaattgaattaaaattgtaattagcataacagacgaagaactgaatatagtcagggagtagaggaaaagtttagattatatttatgacattaaaaatcaacctaatccaacttggttgttagttgttccgtactgcagttgatttttatgcataagaaatattggacggtccaatataatataatattagttgatatatagctttcagttaggttggaaggtggacaattgcaagtgccaagtcaaggttagtggcaagggcggctccatcattcacaatttgcctgccattacctcccttttgcttggagttttcccatcaagcaatacatttattgttgtttatagtgttaaagggattatgcaaatatcatttcatataagctgaaggaaatttcatgaaaaaaaaaatagcatttattatttatactatgaaggcaaccatagaaattaatatcatttcataaagttaaacaaatttaaggcaaaaaggaatttgttgcctatcacattaaagaaaatgatagaattaagggaagaaaatttagtctatgtttagtttttgaaaaatttgaaaaaaaaatggaaagaaagaaaataaaaataaaaaataaattatttttatatgttttcttaaatttcataaacttatttttcttcattgtattaagattaaataattttaaaatatataaatttttaattaattttaattatattttattttcttttatatttttcatgatgaaatcaaacatgaaaaaataattttttttaatatttttttttctttccttattatttttcaagaaccttaaaaatgtaaaagttttaagttttaagttgatttctttttcttttttttagtcttttttatttttaggaaatataaataattttaaaaatctgtaaggatttttttttcatttgataatataatcatatttttataaataatgaacatatactttgagactttgaattaatgtaaatttaaataattatcctcctaaataatatttataaaaattgaatgtagttctcaagaaaagaaagaattaaaataaattgttcaatttttactttttttatttacttaaaatccaactattttccaaaattttgagggagtgagtacatagaatgattcatttttcttctactcataattcattttggagattcaaatgaatgaaaattagatagtatagtctattttcaaattcacaagttgaagaaaaaaaagtgatgatgagtagaaagatgtatcgtcaagttcatcatttaataggcacaccgccacaaatcctcattcatcttgaagaatgaacttagagatgagattttggaagtgtacagtgtgatacgtatgagtggtgtgtattggtacattaagatggataaagatggaaataaaatggagagaaagaaagagagagaggaggaaaaatagaacatgctgctgaatagtatagggtaaccggccccatgacttagcaatacgcaattactgaaaagctccaaccctcctcccaaccatgagccattaatgtcttaagagaatcaggccatcactacagctgtgccatcctccctagcaaatgcccctacgcgttctcaatttggaggacactttttggtcaatttcggtgacgttcatactttgcctagagacaaaatattgatcaatattacaagctaaccgatagagactgattaagagctttaactgtatttggatgcccacttagtttttggagctataagtaggtgcattggagttgggaaaaataaaggccagagtttgggagacttgcaaccaagtttcacaaatacaggggcttaatcaagttgtttcattatccaattattttattataaggcaattccaacctcttaacctctcgatctctttccttctttctgctgcttctatctgggaattgtttccttccctttcctctctttctttttcttgtatttggcttcttctactattttgggctacaatatctcggatctttctgttcccgaactgaaacttttcctcatcaaaagcctgtacagatagagaagagtttgcacatatattaagaaaggaataattttgtcggaaaa

SEQ ID NO: 65 - DNA, 2500 bp, Vitus vinifera
tatattatgtaagtttgaaaaaaaggataatatttgataaggtatttaaaaattatttacttcaaaaatgcattcaacaataataatttttaaccatttatctttcatgttcaatttattggagaaaaattattggtaaatcattcaacttggtcccattaataaataggtactaataaataggtgagagaatggtgaaaaaaccaaagagagaataagaaaggtagagtgaccagagttttttcatttaatagtcagaggtattttaggaattttttgaagacaatatctttcatttcaatttctactctttcattgggttttaagtttaattataaattatatgaggaccttatctcaattattcaacccaactgggatagaaacagaattctccctatttagattagggaaaattgatttaaggttttttttttttaaatagagttaacaataaaatacaaactaacaaactttcaagagaaagaaaaaaaaaacacttataatattacaaaaaaaaaaaaaaaaaaacacatcctaatcacatagcaaaactcaatattttttctctctcttcttttgtcctattaacaaccaaacatgattcaattaattgaattaaactattaaactaataaaaagagccgatccaacttggttgttagttgttccgtattgcatttgcttttacggatgaggaaattgaattaaaattgtaattagcataacagacgaagaactgaatatagtcagggagtagaggaaaagtttagattatatttatgacattaaaaatcaacctaatccaacttggttgttagttgttccgtactgcagttgatttttatgcataagaaatattggacggtccaatataatataatattagttgatatatagctttcagttaggttggaaggtggacaattgcaagtgccaagtcaaggttagtggcaagggcggctccatcattcacaatttgcctgccattacctcccttttgcttggagttttcccatcaagcaatacatttattgttgtttatagtgttaaagggattatgcaaatatcatttcatataagctgaaggaaatttcatgaaaaaaaaaatagcatttattatttatactatgaaggcaaccatagaaattaatatcatttcataaagttaaacaaatttaaggcaaaaaggaatttgttgcctatcacattaaagaaaatgatagaattaagggaagaaaatttagtctatgtttagtttttgaaaaatttgaaaaaaaaatggaaagaaagaaaataaaaataaaaaataaattatttttatatgttttcttaaatttcataaacttatttttcttcattgtattaagattaaataattttaaaatatataaatttttaattaattttaattatattttattttcttttatatttttcatgatgaaatcaaacatgaaaaaataattttttttaatatttttttttctttccttattatttttcaagaaccttaaaaatgtaaaagttttaagttttaagttgatttctttttcttttttttagtcttttttatttttaggaaatataaataattttaaaaatctgtaaggatttttttttcatttgataatataatcatatttttataaataatgaacatatactttgagactttgaattaatgtaaatttaaataattatcctcctaaataatatttataaaaattgaatgtagttctcaagaaaagaaagaattaaaataaattgttcaatttttactttttttatttacttaaaatccaactattttccaaaattttgagggagtgagtacatagaatgattcatttttcttctactcataattcattttggagattcaaatgaatgaaaattagatagtatagtctattttcaaattcacaagttgaagaaaaaaaagtgatgatgagtagaaagatgtatcgtcaagttcatcatttaataggcacaccgccacaaatcctcattcatcttgaagaatgaacttagagatgagattttggaagtgtacagtgtgatacgtatgagtggtgtgtattggtacattaagatggataaagatggaaataaaatggagagaaagaaagagagagaggaggaaaaatagaacatgctgctgaatagtatagggtaaccggccccatgacttagcaatacgcaattactgaaaagctccaaccctcctcccaaccatgagccattaatgtcttaagagaatcaggccatcactacagctgtgccatcctccctagcaaatgcccctacgcgttctcaatttggaggacactttttggtcaatttcggtgacgttcatactttgcctagagacaaaatattgatcaatattacaagctaaccgatagagactgattaagagctttaactgtatttggatgcccacttagtttttggagctataagtaggtgcattggagttgggaaaaataaaggccag

SEQ ID NO: 66 - DNA, 456 bp, Zea mays; identical to SEQ ID NO: 40

SEQ ID NO: 67 - DNA, 2980 bp, Setaria italica
gaacgacggaaactgctagcgtaactatagaattctggaaaggataggcacgtcgtttttcagtccactccgtacagcgacagaaacagacgtctctcaaaaaatcagtacaggtgtaatgacatttacagccacgaaggatcgttttctttgctatacatactcaggtttttctctacttatactaatctttcgctaatttatctctgaccagtaaaaggctgtgtttcctattgtgcgcagaaagatcagaccacacgccaagagccgtgccgaggtatatatggaaacagtacactactatctgcagcagtgcagcatcgatttcttcgccccttctcctgaaaagtcgagatataaaaagatggagaaaacctcggtcaaatttggattagttgcatgcatgcatgcatttcatcgcgaggattacctccgttttaaaatgcttgacatgattttcaaaaccacatttaacaatttgtcttattaaaaatcaatatattatgtaaaaatataaattatatttaaaatatatttaataataaaacaagtcacaattaaataaactatactccttacataggtttataggtttctgaaatctgaacaagacgattatcatgtgcagagtccaaacgtcaacggtgtaaaacaaacacttgaaacccgaagtaaatataccttcatccaacaacattgacaatactactacttcctccgtttcaaattgtaggtcattttagcttttctaatattattatgcatccagacatacactatatctagtgcatagaacaactatacgcctagaaaagtcaaaacgacctataaaggtataaaggagtggtagttgcttatccaagatgattagcgaattgcatcttagaagtggataagatgcttaaatttgcaccgtactttggtacacatggtagctttcctcatgggaattaacttcaaaccgctcttatgacccttcaagtacttgtgtttaagcacacaccttgcattttagatgccataatatacatttttttgtcctttttaaggcattcattttttttagttttgacttgttttgttattgtattactatcacaagccgatgatgcatcatgcatgtaattacctgacctatttcactcaggctatttctagtggagagtttcatctcacagtttccaagaatgacatgtcatcaaaagaggtttgatttctagtggagagtttcacctcacagtttccaagaatgacatgccatcaaaagaggtttgagttgatgaatgaaacaataccccccaatgcagagttttatttcacacccataccatttaattgtgaggcctgtgattggatatgctaagatgaaatgaaactctatagccccaaatgcaagtttcaacaggtttcgtagtcttgaaaacagtgcatacacagtttcatcttgagagcaagtttaataacgcagctagcaagcgggctgcaaggtttctctcagccttttcctagcccactcgtacaatggttaactcttcaccattaatacatgatccacaagtcattctcacaaagtttcttggttcctgtgcccaagtcggctataagcttatagcccgcttctcctctctcacctcttctctctcctccacgtcagcattcagccagcttacagcctcttattatacttgctctgatgaaactcttttcctctctcacttcataattaccttgccatgttatcaatgtgtcatcgtatttaacgtatatgaaatttctatgaaacttgcactggactagcttttttgtttttgcgaaacaccgtcgacatcgagagcagtgcttagttggctgctgttcacacaggtcatcaaagaaatgaagcactgctttaaacatttgctcttatacttggctacaatggaagaggcacctaatttggacgctccatatgctatacgatgaatgtaaaagtagcagtggagaaccgagaacctcttccttctccatcactcaataactacggcggttatctagtcttaaaaatttgtcaacagtgcattattcatgaacaggacgtacgtccactgccaaacaatctcgtagccggaaattaaataaccaagaaaaaaatgaaaaatacaccggcaaattaaattatgtaagcctatctttacatggaaaatgcatgattgggcttgctgccttcgtcaattttctcctttatggctgtacacatatatagcttgaaataaatatgtatgacatgcagatatatgaacgtttattttcacattttccacgaaaaaaagtatataatgacgtccaataaatccaaaatacatgacatatttcgcatatttcgccgtattgtagcacacatattgttgacgaaaataatataaaaatcatgcacccgtctcgctctctctctcctagcaattacgatacgccctctcaataaatgcggattgcaccacctcaacactcgtccgcaataactccttcccctcttcctccacattctcttccacctccgttcccctttcttctcttcctcttcctcctcctcctcccttccccttccatggctgtctagctcctcaggatctctccgtctctccacttcctgctagctacccttctgagcttgcacgcggtaaagaatcatctcgagagctgcaacttgcaggcagacatagagagagatcagagttctatttttgcaaaggcgcacaacatatatagttcttctgctagatctcactgccagtctcacagagcgaaggtttatttgggctagtttgcccctagatctgttgctggctgtgttgttgcttggcaggcaaggtatctctatataggaataggattagcgcctgttctttggctgtagagagagagagttgtcctatgtgtctctgaagaaatggaaacgaatgagacggcaagaaattagggtttgcgaggtggtcagaggaga

SEQ ID NO: 68 - DNA, 2500 bp, Setaria italica
gaacgacggaaactgctagcgtaactatagaattctggaaaggataggcacgtcgtttttcagtccactccgtacagcgacagaaacagacgtctctcaaaaaatcagtacaggtgtaatgacatttacagccacgaaggatcgttttctttgctatacatactcaggtttttctctacttatactaatctttcgctaatttatctctgaccagtaaaaggctgtgtttcctattgtgcgcagaaagatcagaccacacgccaagagccgtgccgaggtatatatggaaacagtacactactatctgcagcagtgcagcatcgatttcttcgccccttctcctgaaaagtcgagatataaaaagatggagaaaacctcggtcaaatttggattagttgcatgcatgcatgcatttcatcgcgaggattacctccgttttaaaatgcttgacatgattttcaaaaccacatttaacaatttgtcttattaaaaatcaatatattatgtaaaaatataaattatatttaaaatatatttaataataaaacaagtcacaattaaataaactatactccttacataggtttataggtttctgaaatctgaacaagacgattatcatgtgcagagtccaaacgtcaacggtgtaaaacaaacacttgaaacccgaagtaaatataccttcatccaacaacattgacaatactactacttcctccgtttcaaattgtaggtcattttagcttttctaatattattatgcatccagacatacactatatctagtgcatagaacaactatacgcctagaaaagtcaaaacgacctataaaggtataaaggagtggtagttgcttatccaagatgattagcgaattgcatcttagaagtggataagatgcttaaatttgcaccgtactttggtacacatggtagctttcctcatgggaattaacttcaaaccgctcttatgacccttcaagtacttgtgtttaagcacacaccttgcattttagatgccataatatacatttttttgtcctttttaaggcattcattttttttagttttgacttgttttgttattgtattactatcacaagccgatgatgcatcatgcatgtaattacctgacctatttcactcaggctatttctagtggagagtttcatctcacagtttccaagaatgacatgtcatcaaaagaggtttgatttctagtggagagtttcacctcacagtttccaagaatgacatgccatcaaaagaggtttgagttgatgaatgaaacaataccccccaatgcagagttttatttcacacccataccatttaattgtgaggcctgtgattggatatgctaagatgaaatgaaactctatagccccaaatgcaagtttcaacaggtttcgtagtcttgaaaacagtgcatacacagtttcatcttgagagcaagtttaataacgcagctagcaagcgggctgcaaggtttctctcagccttttcctagcccactcgtacaatggttaactcttcaccattaatacatgatccacaagtcattctcacaaagtttcttggttcctgtgcccaagtcggctataagcttatagcccgcttctcctctctcacctcttctctctcctccacgtcagcattcagccagcttacagcctcttattatacttgctctgatgaaactcttttcctctctcacttcataattaccttgccatgttatcaatgtgtcatcgtatttaacgtatatgaaatttctatgaaacttgcactggactagcttttttgtttttgcgaaacaccgtcgacatcgagagcagtgcttagttggctgctgttcacacaggtcatcaaagaaatgaagcactgctttaaacatttgctcttatacttggctacaatggaagaggcacctaatttggacgctccatatgctatacgatgaatgtaaaagtagcagtggagaaccgagaacctcttccttctccatcactcaataactacggcggttatctagtcttaaaaatttgtcaacagtgcattattcatgaacaggacgtacgtccactgccaaacaatctcgtagccggaaattaaataaccaagaaaaaaatgaaaaatacaccggcaaattaaattatgtaagcctatctttacatggaaaatgcatgattgggcttgctgccttcgtcaattttctcctttatggctgtacacatatatagcttgaaataaatatgtatgacatgcagatatatgaacgtttattttcacattttccacgaaaaaaagtatataatgacgtccaataaatccaaaatacatgacatatttcgcatatttcgccgtattgtagcacacatattgttgacgaaaataatataaaaatcatgcacccgtctcgctctctctctcctagcaattacgatacgccctctcaataaatgcggattgcaccacctcaacactcgtccgcaataact

SEQ ID NO: 69 - DNA, 3000 bp, Vitus vinifera
tcagactgtcttgagccatcatcatcatagtttaacccatggttgtaaaggatccaatcagagtcacacgctgcacgcgcgcgcacacatttagagggattcctttttgtctagattgtaaaaattataatttttacgaattactatagaattaagacaaaatagtaaaagattcctacctggcactgtaatttttcactttacacgtggtaaattagtctgacatatacagtgcacgctcatttttaacgcatgcatgttagtccaccttcaagcagaggctagatgctatgttcgattcaaaaatcaaaacaaaaaggttgtttcacattatgtccgatttgaaaaaccaagaaagaaaagaaaatcttgtttcatgtagaaggagataaaattttaggcaaagatcaaaatttggtaagaagtaacataattgttggtttgtttatcaaatatggcaagctttacacggtaatatgcaaccaatatatgcataattacatttgtatgtagttaatagcataatagcatgcagctaatgtgtacactcttttgatatgtacatatcacactacaccatggtgcaagaatgttagagcatatatagaaatggggggtttcatgaattacaaatatttggtaagcttgttatctaaaggcaatattaggttgatatttttttcaatttggtgagggaacaaaactgccttattaacaatatccaaatttatgattgagtggaataagaaaaattaagggtgccctgaagacagccattagcccacagattttggtacaataagatacgttatcaagctaagagatttgtgcaagggaggcatgaatatagtaaatgatttattctgcatgcagaccctgctcgtggctcaggcatttaatggaatattgctagggagaaggaggagagatggggctaaaatgcttcatcacagctccacctccacctcctcctcctgataattccctttcttaattccctcacatacccacatgtaataatagatctttgtcacggggattggtgccaaaaacatcatatttggaacattaactattaatccatgttttccatacatgttactcacaaaatcttctgtttatacaataaattattggatgcatgtagcaaaatccttttaaggggtgattcattagggcaaatcgtgctttatggacatggaagttcaactcaattgaggcgtaaacagtgaaaacagtgtcacaaaacaaccatttgtaaaagcttaaaaggtactgtatatgagaagcgattaatgatatacaaacaaggagagaaacaataaaagaagtttgaaaaggagttggagaaaaggtgatgggagaatgagaaaaaaaaaaaaaggaataaaagaaaaagaaagagttgaaaggagtgctgcagttaagatgggtgtaattggcttcaccatacacgctctctcaaagacatctaaacatcaaacgcttatatgcttctgtatttctatatatatttctctctccttagcaattacacctccatccaccataaatgctattgcaccctctcaatacgctctgcaataactcctcgctgccacatcttctccacctgttaccctttcttcttccctttctcaccttctccaaagctctctgcctttcgagtctatctcctctttttcgccgtccctttattctccctctctctctctgcctcttcctctctcagtgttcttctcaaaacctgttactctcatctaaagctgccagaaaaccactctttcagcgcccaaaaagtggttttccggtgacccaatagtctctaaaacagatctgccactttgctcactggacttgaccttcatcttcaaaagggtcgttttgcttttctcccatagcttccgcacctgtaagttattttgaccccataggtcttctccatttttcaccagtctttatttatttttatttttttttgagtggggggtctaaatggggttgcaacaccatcattctcatccttaactgtcttgagacacaagattttttcacctttctttgcatattttattaacttctgagtttttgctctattttccgttatcttttttgcagtagagaaagagcaaaggttgaggttgaggttggacgcaccgagatcttcgtgggcgttatggtttgaaattggtgtttcaaagcccattccatactgtccactctatcttccatttttctccagtaagagctttgtgacctacgaacagaaatacagggtcaagatcttctttcaaagcccaaagccacagttgtagctcctccactgctgcatgtttagggtttgtgggggcagtgacacttcccggccggaataatgcttccggctaatgactggccactgccaattgaaaggaacctaaaggttgctggatttgggttgtcatcaggactaattctaagcgtggtaagccttcgtggcagtccaagttctattgatgtccatttcatggactgtgagtctgtgaagactgttagggttgtctgggtttgggtttttcttttatcattttcttagtcatttcattgtttcctcatctctcttttttctttttctttttctttttctaaatatatatacatattcaagatcaattagattagtagagggtttttgctaggcattaaggtatttcaagaaaaatcattctcgatacaaacgctaaaaagctgttttgcagatgagagagagagtcttctcataaacaggttttcaaaagtgggatagggatccataacctaagaaaattaattcactgcttaatactatgtacagatttccacacatgattaattcttttcttcttaattcaaattcttgagggtttttttttttttttttcattctttacatgggcttcttccttttgaagtggttgactcatttcattctcttggcagattgaagaaccctagctttggaatcataaaggatctgtgaat

SEQ ID NO: 70 - DNA, 3134 bp, Populus trichocarpa
aattaatcttttttttgtttgatttagttcgttaatattaattttttttctatttagttatcacactctcaggatacggatcccaggtttgacgggttaacccagttgattcagaatgtttttctttttaatttggtttgcataatttttgttagagtttttggattcatacatgtgtttggaaaacacccctcaagcctatttttagtggttttattacaaagaaaaatggatgtttggccaaacaaagcctaaaatttttttaaatataaaaaaacatcttttttcttgcatatggctaaaaactcctaaagttatttaagcatttcttttataaaaaaaatttaaaatacttttatatgttttttctaaaaaaaacatattgcataaattttacaataagtttgtaaaatttctaaggattttggcctacatttcagaaatacaaaaaaaaattattttgtttcttttaatatgtgagattatgaacttatatgtaagacttattcctgctattaaataaaaaacaattttttttatattggcactagaacgattaagtttttaacctgataagatgaagaccttcttacagagaaagacttttcttaaaccctagaatgaccaacggttagaaaacacaacattaccttagtttacgttagacaaataaacaatacagtttacctcaggtacgacgtattaggggtgttaatacctttcttttatacaatcagttctcttccccagactcagagaccagttagggtttctagtgatcaaaatattaagtgacaactttcatttcttttttttttctactgataaaagacaagtacccttcttcttcttattttttttttaatgttgtcaatttatttataaataagagacaaaaaaaagaaaaaaaatattgtccatttattaaacaaattgttatctaaatttgtgtgtgtataatcattttcatttattagataggcatttcttacaatgattttaagttcatgtagactttaatttattgtgtgttatatgtgatatatatttcacaactcatgaaaattataatgattttgtaagataacatctcctatttctgaccccagaaaactcctagatatattctcattaattacgtttttatttaaacaataataataataataataataataataataaataaactatatatatagtttatttattattattattattattattatatatataatttgattgtgtgtataatttagccatattttttcttcgttaatcatgttgttcctaactaggcatcaagaccacaaaatcatgaggaaattatgatttcatacacgaatattgatcatctacgtacataaatttttgcactggtgaagcaacaacaatggtggaaatttggaatccaagaagccgtaattcacaccaccatacttctagaggaaatttaaacatgaaataatgatcgctccttttcatctctttctcactctctcgcatttacacctctctcccaccataaatgctagcaaaccctctctatacgctctgcaattactcctctgctgccacatcctcaccacctgttccctttcttcctttctcagcttcttcaaaaccttataatttgtctcctccttttcctcttccgtttctctctctgtgtgtgcccttttttctcccatcatagtttaatcatacagtcatcttaaaacccttttcagaacatagggtctctcttcaaaaaccagccagtaaaccacttgtctagccctaaaaactggttttgtagagacccaaaacctcttccatcacaaatctaatccttgtttccatggaacttcaaaggcttctatattttggtaagttgcacaccttgtctataaaacctttcaattcatttctcttcaccataagattctctcattttcagttttatatcatgtcctaatctttttcctaaacataaaaatggtgttttttattattttttgtgcaggaattgaaaatgtcgagtgggatggattgacctagatcttagtgggcgttatagtcttggtaatggtgtgttgaaatttatttgtcaaagcttcagagaggggtccatttagtgtcaactcttcatgctcatttgtttttttatataattttaatcttttggaacgtaaaactagaaaggacttgagacttttctttgaagttatgacccaaacaccctacagtcaatcctcctctcttactacttttctttgatgttatgaccgacccaaacaccctacagtcaatcctcctctcttactacttgtaataatctttttttttggcttttgctcaaacatcttgagagaatctatttcgcaaaccaaccccacatacagccaacgtaagcagcaaaatcaatcatgtcatatcctcaagagatagaaagagagaaagataaggatgctgcttagggtttgttggtgagagtaagatatgccttctacaatggagtttaaaggagaaaaaggttgtcagatttcaatcatcctctaaggttagtcaatcaggtaaggttcctctcactttggttgaggttcttaaaaagtgtttttattcactaaatatgcttaaacaaagtaattaaaacgtttccaagcaacatccttcttggaatgaacgcataacgcttttttttttttgagtaaaaagagagagagagagagagagaagagagaggaagataaaaggtgttatcttgcttatctggtgattagccatctcttgtaactacagctacgacagtgtggaatacacttcaccttgccctacaaatttcaaacaacatttattatgttgggaatttaacttggttttgctttttttcctccttgtactcttttttataattcatcaatgtttcctatcaataaatctttccatatagatgttaatttcttatctacaaacatctcatatatagcctttaatacttttctttacttgtacacatgatttactcacccctttagcatgtttacatggcattccttaggattattcttctttttttatttgcttatttatgattttttatttgcagattggaaggacagcttagcttaaaatttaagggatttatacaa

SEQ ID NO: 71 - DNA, 3091 bp, Populus trichocarpa
aattaatcttttttttgtttgatttagttcgttaatattaattttttttctatttagttatcacactctcaggatacggatcccaggtttgacgggttaacccagttgattcagaatgtttttctttttaatttggtttgcataatttttgttagagtttttggattcatacatgtgtttggaaaacacccctcaagcctatttttagtggttttattacaaagaaaaatggatgtttggccaaacaaagcctaaaatttttttaaatataaaaaaacatcttttttcttgcatatggctaaaaactcctaaagttatttaagcatttcttttataaaaaaaatttaaaatacttttatatgttttttctaaaaaaaacatattgcataaattttacaataagtttgtaaaatttctaaggattttggcctacatttcagaaatacaaaaaaaaattattttgtttcttttaatatgtgagattatgaacttatatgtaagacttattcctgctattaaataaaaaacaattttttttatattggcactagaacgattaagtttttaacctgataagatgaagaccttcttacagagaaagacttttcttaaaccctagaatgaccaacggttagaaaacacaacattaccttagtttacgttagacaaataaacaatacagtttacctcaggtacgacgtattaggggtgttaatacctttcttttatacaatcagttctcttccccagactcagagaccagttagggtttctagtgatcaaaatattaagtgacaactttcatttcttttttttttctactgataaaagacaagtacccttcttcttcttattttttttttaatgttgtcaatttatttataaataagagacaaaaaaaagaaaaaaaatattgtccatttattaaacaaattgttatctaaatttgtgtgtgtataatcattttcatttattagataggcatttcttacaatgattttaagttcatgtagactttaatttattgtgtgttatatgtgatatatatttcacaactcatgaaaattataatgattttgtaagataacatctcctatttctgaccccagaaaactcctagatatattctcattaattacgtttttatttaaacaataataataataataataataataataataaataaactatatatatagtttatttattattattattattattattatatatataatttgattgtgtgtataatttagccatattttttcttcgttaatcatgttgttcctaactaggcatcaagaccacaaaatcatgaggaaattatgatttcatacacgaatattgatcatctacgtacataaatttttgcactggtgaagcaacaacaatggtggaaatttggaatccaagaagccgtaattcacaccaccatacttctagaggaaatttaaacatgaaataatgatcgctccttttcatctctttctcactctctcgcatttacacctctctcccaccataaatgctagcaaaccctctctatacgctctgcaattactcctctgctgccacatcctcaccacctgttccctttcttcctttctcagcttcttcaaaaccttataatttgtctcctccttttcctcttccgtttctctctctgtgtgtgcccttttttctcccatcatagtttaatcatacagtcatcttaaaacccttttcagaacatagggtctctcttcaaaaaccagccagtaaaccacttgtctagccctaaaaactggttttgtagagacccaaaacctcttccatcacaaatctaatccttgtttccatggaacttcaaaggcttctatattttggtaagttgcacaccttgtctataaaacctttcaattcatttctcttcaccataagattctctcattttcagttttatatcatgtcctaatctttttcctaaacataaaaatggtgttttttattattttttgtgcaggaattgaaaatgtcgagtgggatggattgacctagatcttagtgggcgttatagtcttggtaatggtgtgttgaaatttatttgtcaaagcttcagagaggggtccatttagtgtcaactcttcatgctcatttgtttttttatataattttaatcttttggaacgtaaaactagaaaggacttgagacttttctttgaagttatgacccaaacaccctacagtcaatcctcctctcttactacttttctttgatgttatgaccgacccaaacaccctacagtcaatcctcctctcttactacttgtaataatctttttttttggcttttgctcaaacatcttgagagaatctatttcgcaaaccaaccccacatacagccaacgtaagcagcaaaatcaatcatgtcatatcctcaagagatagaaagagagaaagataaggatgctgcttagggtttgttggtgagagtaagatatgccttctacaatggagtttaaaggagaaaaaggttgtcagatttcaatcatcctctaaggttagtcaatcaggtaaggttcctctcactttggttgaggttcttaaaaagtgtttttattcactaaatatgcttaaacaaagtaattaaaacgtttccaagcaacatccttcttggaatgaacgcataacgcttttttttttttgagtaaaaagagagagagagagagagagaagagagaggaagataaaaggtgttatcttgcttatctggtgattagccatctcttgtaactacagctacgacagtgtggaatacacttcaccttgccctacaaatttcaaacaacatttattatgttgggaatttaacttggttttgctttttttcctccttgtactcttttttataattcatcaatgtttcctatcaataaatctttccatatagatgttaatttcttatctacaaacatctcatatatagcctttaatacttttctttacttgtacacatgatttactcacccctttagcatgtttacatggcattccttaggattattcttctttttttatttgcttatttatgattttttatttgcag

SEQ ID NO: 72 - DNA, 3940 bp, Medicago trunculata
tgattactctagagagtaagttttttccaacacatccaactaatatctctatgaccactcttcatacaacaaggaacactcacacacagtaagaaggcattgcgaaactcggtctaacttgttctcttctaggccactatttcaaaacaaaaaagtttctcacaaacaattgttttttaagaaattaatatgggatatattaacaacaacgataagctctttagtataaggtgtactagagaaaccatctaaaaaaataaactgtcatataaagtgcgtttgatttgctaaaaaaatgaaggacaggacagaacaactctagttgtccagtgtttgatttgtaaaactgtttcaggtacaggacaaactggaggcaagggacaggacaaaaactcatatttttgtccctcaccaaaccacaacacaactttttgtcccacgtacaaattgtctaaaataccaaaatagtattttgtccctaaaaaatcgtaaaacaaaaaaattactcaatgccataaaaaatttgtcatgtgttgttctgccttgtgttgtactgttctatcttgtactgttctgtccagtacttgttgttttgcaaaccaaacacacccataaagtatatacaagaacaaaggctagtcaatacccatacaaagcaaatgatccgactaccatctctgagaaccgtacacaaacgtggcgttattagcttttaaccaccaaaacgaattaaatttaatttatctaagagttataagataggagtttcaatgttgttgaatagcctattattgcgatcattctcacaaataataagtataatctgtatttttttttgaaggaagtataatctgtacttaatggatccaaaagttaaccataagtaactattaatttcggttggacattttttgtaacatatttacccttaaaacaccgttcttttaaaatttaaatgtaaatatacatcataattaaataggtccttaaaaaaaatcataactaaataggactattaaacaaattacaaatttaacaacaatacagttcaatccaaattcaaattttaaaaaatataaaacatgattattgaaaaataaatttagattaagatatcttgtacaattatcttatcttttttatctgaataattgtactcgtcttatctttttttaaatcatagcttgtgtacccttaaaaaaaatcataccttgtgtaaaaattcataatcatatttacatcgttccttttcattttataactaatttcttttcttttgattgcagggattgattcttcaataacttcgacaagaaagtcgttaggacgaacactttaaattgaaagacaactttcatgacgacatgttggtacttgtgaaagtggaggaatataactattttttaagctaatttcatccgctcgaacaacccaatttctttaattcggagattcgtccaagatattgaagactgtaacttggagcatcttcatattggtgcattgttgaaggacatcatctatataagttggaagcggcctcaagaaggttggaccaagctcaacatgatggtgcttgcaaagatacgagggttattgctggatgtggcgatctttttcgtgattcagacggtagatggatcaaaggctacactaagaagattggagcttgtgatgccttatatgttgagattttgatcgacatgatttctgataatttcaagttcaatgagaatattcctgttttagtttaccggatctgaaagttgccgaagatgagttgaaatgttcaactcaaccatacttgacgtgaaggaaataggagtgctgattggctcgttaacttaagcatttctacggatcactttaatttactaatgttggagtctccttctagcgaggtccaaagaatccttttagatgatttatccaggacttgcatgcctaggaatcttcgattagctttttagttctatttttttttctttgccctcttgtaaaaaaataaaaataaagatctttgaaagtacagaatgtatttatatatgtaatttttttcctcaaataccaatatatactactagtataagtagagtatatttacattatcgtagagtacgtgaatgaatataagtaaattcagtagggaagagtaaaaattaacgagtttggtagccgtcatcttttgcaccatctactctcaaatccaattttttttactacacaacacaataatctctctctctctctctctctctctctctctctctctctctctcacatagtctctctcatgtacactactagcaattactacacctcttacgcccaccattaaatgcaattgcaccatctcaatacactcagcaataactcatcactgccacaattttcctctccatccgttcactcttatttcctttctcttccttcaattcctttgtcctctcaccttcttcatcgtcttcatcttcttttcttcttctttctctctttaaacaatctactaccttttttaagctagaccgtccaaaaacactcatcaagctttcgttgcttaatttattaccatatacccaactttccataacttcctcaaaaaaaccttctcttcttttttcatattcatctttgaaaaaagtgtcttttctttttacttctttttgtgcaccatagtagatctacattttttcttcctcttctagcttctatctctctttagcaactacccttcctcttggtaagtggaaaaaaaaagtctttgttatcattaattcatttcacatctcattcacaccaatatcattgtttttgtaaaactaaatctgttcacaagtttttttcttttaaaaatacttatgtctccgtccatatagttagggttgctagaatgtcatatatttattttttgtttttttttccatcttttttctttctttctgattatgcttgttcctatgctgatttcaaatataacaaaagaatttaacatgcattttaattatgcttaaaaattcttagaagcataaagaaaaaaaatctggactttgatcaccccaatattttttagtttttggttataaagtgaggtcacgtttttatatttgagtatttttttttctctcatgttattgatgtttttgtttcctttttgaagtggcacattaatctcattgaaacaccgctaaagctgacagaagaatctaacaaagaattcatcatctgaaagccatttaaggatctaagaaaagagagagaaaaaattaaaagaaggattttctagttgaagcttttttgattgaaatatgcaagctggtttaatgattccagctagtaacatgcattcaatgatcggaagaaacaacaataacgttggtgtctttggtttatcttcatctctctctttatcccaggtgaatcttcttgtttttttttttccttcacatttctatcaaaatttttagtatattaaattaataataataataacaattttgttctaatgttaatttaatttgataaagggtcatctattttgactttatctttgcaaagataattattttctcttaagtcaacatttggtctttattgaaagaacaacctaaacaaacaaaaaaacctttcattgtattttaccagtccaagtatccttctcgttattcggaaaccgcgttattccttttcactttttcactatttaaattcattttcctcaaaaacatcaacttagtcaaattcacatgtttttctttttcatcaagtttctccaatttaattagaaaaaataaataaacaaaaattgtttttgttgattttgttttttgttgttgttgaatgtactatgtactatgtatgtactatactatatattatgtgttaaattgtttttgttagattgaaaacaataagcatttggaatcttaaagatctgtagaaa

SEQ ID NO: 73 - DNA, 3897 bp, Medicago trunculata
tgattactctagagagtaagttttttccaacacatccaactaatatctctatgaccactcttcatacaacaaggaacactcacacacagtaagaaggcattgcgaaactcggtctaacttgttctcttctaggccactatttcaaaacaaaaaagtttctcacaaacaattgttttttaagaaattaatatgggatatattaacaacaacgataagctctttagtataaggtgtactagagaaaccatctaaaaaaataaactgtcatataaagtgcgtttgatttgctaaaaaaatgaaggacaggacagaacaactctagttgtccagtgtttgatttgtaaaactgtttcaggtacaggacaaactggaggcaagggacaggacaaaaactcatatttttgtccctcaccaaaccacaacacaactttttgtcccacgtacaaattgtctaaaataccaaaatagtattttgtccctaaaaaatcgtaaaacaaaaaaattactcaatgccataaaaaatttgtcatgtgttgttctgccttgtgttgtactgttctatcttgtactgttctgtccagtacttgttgttttgcaaaccaaacacacccataaagtatatacaagaacaaaggctagtcaatacccatacaaagcaaatgatccgactaccatctctgagaaccgtacacaaacgtggcgttattagcttttaaccaccaaaacgaattaaatttaatttatctaagagttataagataggagtttcaatgttgttgaatagcctattattgcgatcattctcacaaataataagtataatctgtatttttttttgaaggaagtataatctgtacttaatggatccaaaagttaaccataagtaactattaatttcggttggacattttttgtaacatatttacccttaaaacaccgttcttttaaaatttaaatgtaaatatacatcataattaaataggtccttaaaaaaaatcataactaaataggactattaaacaaattacaaatttaacaacaatacagttcaatccaaattcaaattttaaaaaatataaaacatgattattgaaaaataaatttagattaagatatcttgtacaattatcttatcttttttatctgaataattgtactcgtcttatctttttttaaatcatagcttgtgtacccttaaaaaaaatcataccttgtgtaaaaattcataatcatatttacatcgttccttttcattttataactaatttcttttcttttgattgcagggattgattcttcaataacttcgacaagaaagtcgttaggacgaacactttaaattgaaagacaactttcatgacgacatgttggtacttgtgaaagtggaggaatataactattttttaagctaatttcatccgctcgaacaacccaatttctttaattcggagattcgtccaagatattgaagactgtaacttggagcatcttcatattggtgcattgttgaaggacatcatctatataagttggaagcggcctcaagaaggttggaccaagctcaacatgatggtgcttgcaaagatacgagggttattgctggatgtggcgatctttttcgtgattcagacggtagatggatcaaaggctacactaagaagattggagcttgtgatgccttatatgttgagattttgatcgacatgatttctgataatttcaagttcaatgagaatattcctgttttagtttaccggatctgaaagttgccgaagatgagttgaaatgttcaactcaaccatacttgacgtgaaggaaataggagtgctgattggctcgttaacttaagcatttctacggatcactttaatttactaatgttggagtctccttctagcgaggtccaaagaatccttttagatgatttatccaggacttgcatgcctaggaatcttcgattagctttttagttctatttttttttctttgccctcttgtaaaaaaataaaaataaagatctttgaaagtacagaatgtatttatatatgtaatttttttcctcaaataccaatatatactactagtataagtagagtatatttacattatcgtagagtacgtgaatgaatataagtaaattcagtagggaagagtaaaaattaacgagtttggtagccgtcatcttttgcaccatctactctcaaatccaattttttttactacacaacacaataatctctctctctctctctctctctctctctctctctctctctctcacatagtctctctcatgtacactactagcaattactacacctcttacgcccaccattaaatgcaattgcaccatctcaatacactcagcaataactcatcactgccacaattttcctctccatccgttcactcttatttcctttctcttccttcaattcctttgtcctctcaccttcttcatcgtcttcatcttcttttcttcttctttctctctttaaacaatctactaccttttttaagctagaccgtccaaaaacactcatcaagctttcgttgcttaatttattaccatatacccaactttccataacttcctcaaaaaaaccttctcttcttttttcatattcatctttgaaaaaagtgtcttttctttttacttctttttgtgcaccatagtagatctacattttttcttcctcttctagcttctatctctctttagcaactacccttcctcttggtaagtggaaaaaaaaagtctttgttatcattaattcatttcacatctcattcacaccaatatcattgtttttgtaaaactaaatctgttcacaagtttttttcttttaaaaatacttatgtctccgtccatatagttagggttgctagaatgtcatatatttattttttgtttttttttccatcttttttctttctttctgattatgcttgttcctatgctgatttcaaatataacaaaagaatttaacatgcattttaattatgcttaaaaattcttagaagcataaagaaaaaaaatctggactttgatcaccccaatattttttagtttttggttataaagtgaggtcacgtttttatatttgagtatttttttttctctcatgttattgatgtttttgtttcctttttgaagtggcacattaatctcattgaaacaccgctaaagctgacagaagaatctaacaaagaattcatcatctgaaagccatttaaggatctaagaaaagagagagaaaaaattaaaagaaggattttctagttgaagcttttttgattgaaatatgcaagctggtttaatgattccagctagtaacatgcattcaatgatcggaagaaacaacaataacgttggtgtctttggtttatcttcatctctctctttatcccaggtgaatcttcttgtttttttttttccttcacatttctatcaaaatttttagtatattaaattaataataataataacaattttgttctaatgttaatttaatttgataaagggtcatctattttgactttatctttgcaaagataattattttctcttaagtcaacatttggtctttattgaaagaacaacctaaacaaacaaaaaaacctttcattgtattttaccagtccaagtatccttctcgttattcggaaaccgcgttattccttttcactttttcactatttaaattcattttcctcaaaaacatcaacttagtcaaattcacatgtttttctttttcatcaagtttctccaatttaattagaaaaaataaataaacaaaaattgtttttgttgattttgttttttgttgttgttgaatgtactatgtactatgtatgtactatactatatattatgtgttaaattgtttttgttag

SEQ ID NO: 74 - DNA, 3000 bp, Arabidopsis thaliana
acgtacgtataactccatctatatatctgtacctacatatatacagtaaaaatcagaaataagttgggttattgtttttttatatatagttattttaaagaatctaggtaaagtataaacttactgaaaagaaaaacttgagtgttaaagctatagctataaggactttaaaaaaaaaaacaaagcttaagaactaggtaattaaatacgcagtatatttctctatatattcgcgtgataaattaagatgaatgcatggcttttacaaattatcacctttttaatgggtgatccgtattttaaatagcttaattgcacgttatagttataaatgcttgggccacaaagtaattaatatttctaggcatgtaaaatgaagtcttactgtgaaaaaagtgatatttcattgacttccttaaattgaaaaaacaattgtttcgtaaacaaaactcaaaattaaggtgatgatttttagattttcttcttttaaatgaaataaaataaatacatcactcaatcaacttctgtctgactaacaataatacaacctaaacttctataatatttaagaaaatgccatgtggaagaagaatcatgaaattttccttctttacaattaaatttataacaaagatatgaaataataataaaataaaatagttaaaaatataatagtcatattttttgaaagtaaaaattaaatttatatctcataaagataaatattaactataacaagtcattgaattttagttaaaaaactatataatttttttccatattataaataatctaagagtattaaaatttcagaaaattacttttaaaattgtatccttgacaaatggggactattgtctaactttttctgtaaatggagaactgtattaaagcaaatttcaatatagttaaatctttttttaatatagttaattttgttaagtggtgatttattgcatatgcataagttatgaataatgctaatgattttttaaaaataactacatatctaatagataaatgtaagtctcataggctcatagaccgttagccgtcattcctcaccacattataatattttaaataaataaaaaataaaattattttaggttgacattgtatataagatgaaaaacaacacataattttgtaacataaataaaataaattgtaacatatctctctctctctatatatatataagcgtgtaggataattaagtgtccctctcgcaccatttaatttcattgcaccctctcaattctctctgtcattactctctcatctctcttcctccaagatttgcacctacctttcaaaccttttgctcgccaacaaaaccgcgcttcacaaaaccatcagcggttttccgagaaacaaatctcagaccagacaccgctctactcttctctctctctccctctagggtttcgtcgcttcttcctatatcccagtgtatgtctcgaaaacctcatcatttctgctgttttctttattttatccattaattcatgtacacaaatttatttgtttaaagtatcattggatccattacacttcagttttcttagcatctttataaaactctcactttcatgatgttttttttttataatttaatatatcctgtatgttgaattttcagttagtcatctatattttgtcttaaattttgccttctttagcattaattaattgatttcttgcctctaatatctttcattcctctcctaatttgctttctgactttctgatttattgtattcttctttaaataatcttatcaatttctgcatagtcagagatgaaaccttcaagaaaacaataaagaggaaagattaaaggttagtattcccttgcctaccaaaaaaaacagaaaggtttgtattctcttcgtatatccttattttcattatacgtttggttttatatataaacacgtgtatatactttatagtagtagtatacatttacatattaatgtgtgtaataaaaacgtttaaatacgatgatgatgataagaaatagctggaaaaaattaatacatcacccaggccttatgtcacgttggttgtaagttgtataataactatatgttggtccgtcgcacaggtgcacagatataatactatttttttcatttcaatttttttttctttcttaatcgccaaatagtagtttacactttttcctgaagagtttttattttttgaaaatctactaatgattatatttaattaaattttgttttgttctcacgaaaatattgtttttttaataaacaggatagagttgggaatttatttgtacctactttttcccattttatttgctttgaacaaatgagtccaacatttctcttttcgtcttctctttcctatcccatctaaatcaaaactgatcaaaatacctcgaaattttaaattaaatcaccatccatcaaagctattatagtgtagaaattttaaagttttttctttggacaacaattgatttccatctacactacatatgatatgactcttgaatcaatcatagtttttatttcagtctgctgattagtttttttcttttcttttaaaagggtaaaaaatcggtagtttcgaataattttgagtatgtgaaaattcattatttttgggttggttattcaataacaaattaatttgtgattgtgatgtcttttttatgcaaggctcttttttcttgctttcaattagtgggtcctttgtttcctacaatcatctccaattcttctgtttgcttatatcattttgtatgatcttcaagaagaaagataaacgactccgaagaaagatttaagttattgttgttcatacaaaaagaaggttgtaaagttgttgacgtggacaaaagtattgccatatttttccagcctcgaagaaatttcccttcttcttcaaaccctaaattttgacaaaactctctacttttttttgcttctagggtttgctttcagtttccggagtataagaaaag

SEQ ID NO: 75 - DNA, 3641 bp, Glycine max
tatatcatttgtttttaatgaagttatttttggtttagtttcttttaatgaagttactataaatttaattatagttgttcaaactaatatttagtccgaacaaaatacaaattggctaccgctatgcgctatctaacaaaattttccgagtcataacatgcagatgcatgcggttcaaaattaatacttgcactcatcataaaatttgttcatatataggtaagactttccacgtcaaatataaattaaagtgcatagaacaaaaataattaaattgcaaatgtattttatggtaaattgcaattctttataataatgtactatacaatatttatttagaaaacaaaatcttgcgttacgaattaatttttttaatgtagttacgaattgaattacacggttacaagtaccatgcatttttatatgctaagagaaattcatatttttaatcaatcttttacgaagtgactagcttacacggttacactacattgtaatcaaattatattatatgtagtatcttttttcttttataaaatatattactagtaagtatcttgtgcggatacttttaaacacaaagaaaatataaaaaatacaaaaatatataattttaaaaatataaaaatataatcaacagaatgatttttcttaataatttgaaaatattttatcatgcataatgttaataaaagaaactcaagtattaattaaagaaattaaaaaactaagaaccttctttaatatgattaattgaggaaatatatcgatttaacacatttcaagaaataaaaaatacatgcttatgtaaaatattaaaaatatatataaatgttatatctccgttaaaaacacgtttaaatttagagttcaattaaaatatattgaaaatgtttttttttgtagtattatctaatactgtataaattataccatgtaagataatattcttgattcttgtaagaattactttaaaaatatatctaaacggtttgtaatcatgcaatattataaattttcttatattccgtaaaaaaataatattttattataataatatataaaatcaaactcttatattcataatataggaaatagtagtcttcaaaaaaacaggaacgaataaatcatctcaatcttatcatatcaattattaattacctaatttctttaattaattaaattatcaataaaaaaaaggtgaactttggatcaaataatataaagttatttcaaattaaccaatgttgtaaaatttggatcttaaatatacagtcacattaactttgtaaacaatcttacgcatttgagcaaggttacttccgctgaaagatgtatataagatgaatttgtttaaagttttaaaagataactttaaaataaacattttttaagtaataaatatgggccaatttgtttaaacttgaaaaaataatttaaaaataagtacttttttaaataagtagatagaatttgtgtcagtttgtttaattttatttattgaaataaatgcttattttattaaaataaataactttctatttttttaatgtgttttcctaaattatttctacttgttttaaaaagaaaatatttgcaaaaagacatttatataaaaaaattatttttaagttttttaaaaaaatttaaacaaactcaccgtttgtttcttcaaataagcggatttttttaaaaatagaaacagttaaaaaaaataaaataaacataaaaataaatattttattaaaataaatacttattttaacaaataagtttaaacaaattatcacatgatttacttcttaaaaaaacaaaaaaaaactgtttattttaagtaaaaaaagtctagacaaacacatgataaaatcataaaactacttattttatttttaaaaaaatacttattttaaaaatatgctttaaaataattagctcataatttgcatcaaaaatcacaactcacgaattgggagtgaataaattaatagtaattagcttggctctttttcttattttttactccctattttccttttttataaggcttactagactcttttgcatgaccagcgtctctggtcaaaagaattaataataataataataataaaattcattaaaaatcacattaaaagaatattaataatcacattaaaaacatatttaaaatcacattaaagcacattaatgacattttcaatagtactaagaactctttcaattcttgaaccaatattactcttatcttaatggaaaatactctacacttatccgaacgaaaaaactgcaaaagagaagaagaaatgaatggagtgacacgcacaaattaatttcaagataccagcacttagcaatttagcatttgtttggtagccgtcattcgttgcattgcattgcatttgcatttgcattgcaccgtcaactcgcaaaatatttataagttttatactacaccaaaccaaaaaatatgctgcgtctctttctctctcccctctctagcaattacacctcttttgccctccattaaatgcaattgcaccctctcaatacgctctgcaattactcttcgctgccacattttcctccatctgttccccacttctctctctccttcaatgcccttgtccctctctcttcttcttcttcttcttcttctcactttctctctgtaacaccttctcttcatgatatagcttcttcaccttttttttctttcttttctttgttaccatatataagtaaactagattccataactgtcccaagcccttccttcaaaagggtcctctcttttcaacccaaaacagatctacaccttcatcttccaccaccactctcactggtaagtgctaaaaaatattgataataaaagcttctgtcgcaaccagggtcgcggcgtgtttgtgtggaacattcatgttttgttaaggttctctaaggtcacatttgtttttttttttttttaaacgaaactaatgaagctgtttggtacattttgtgagttctactaacattttccgggtgagtcgcttgcagctagggctgtgagaaaaggaacgttattaggtctgtaagaaaaaagaaaatatcctgaaatataggatgcgttgtaggattctccgagatcttcgtgttgttttattttataaataaaaaagttttgattttgttttgtgaaaaggcaaaagatcagataagggttacaatatttcttttcttttttattctgtttacatatattgatgatatatatatgcatagcgtatatttgtttcgaaattttgataagtttttatctttttaattttttttcggccgtttgtataactgagttttgtagtaacacactgactcgctttgacattgtcatctgacagaatccaagggctcaacctcttaagctttttctctatccaagaacctcttaagagagagaaagaataagagaaagagaaagtgagagagccaattctacatttgttggtggtggtttttgaggcatgtgaaataatccaagggctcaacctcttaagctttttctctatccaagaacctcttaagagagagaaagaataagagaaagagaaagtgagagagccaattctacatttgttggtggtggtttttgaggcatgtgaaat

SEQ ID NO: 76 - DNA, 3509 bp, Glycine max
tatatcatttgtttttaatgaagttatttttggtttagtttcttttaatgaagttactataaatttaattatagttgttcaaactaatatttagtccgaacaaaatacaaattggctaccgctatgcgctatctaacaaaattttccgagtcataacatgcagatgcatgcggttcaaaattaatacttgcactcatcataaaatttgttcatatataggtaagactttccacgtcaaatataaattaaagtgcatagaacaaaaataattaaattgcaaatgtattttatggtaaattgcaattctttataataatgtactatacaatatttatttagaaaacaaaatcttgcgttacgaattaatttttttaatgtagttacgaattgaattacacggttacaagtaccatgcatttttatatgctaagagaaattcatatttttaatcaatcttttacgaagtgactagcttacacggttacactacattgtaatcaaattatattatatgtagtatcttttttcttttataaaatatattactagtaagtatcttgtgcggatacttttaaacacaaagaaaatataaaaaatacaaaaatatataattttaaaaatataaaaatataatcaacagaatgatttttcttaataatttgaaaatattttatcatgcataatgttaataaaagaaactcaagtattaattaaagaaattaaaaaactaagaaccttctttaatatgattaattgaggaaatatatcgatttaacacatttcaagaaataaaaaatacatgcttatgtaaaatattaaaaatatatataaatgttatatctccgttaaaaacacgtttaaatttagagttcaattaaaatatattgaaaatgtttttttttgtagtattatctaatactgtataaattataccatgtaagataatattcttgattcttgtaagaattactttaaaaatatatctaaacggtttgtaatcatgcaatattataaattttcttatattccgtaaaaaaataatattttattataataatatataaaatcaaactcttatattcataatataggaaatagtagtcttcaaaaaaacaggaacgaataaatcatctcaatcttatcatatcaattattaattacctaatttctttaattaattaaattatcaataaaaaaaaggtgaactttggatcaaataatataaagttatttcaaattaaccaatgttgtaaaatttggatcttaaatatacagtcacattaactttgtaaacaatcttacgcatttgagcaaggttacttccgctgaaagatgtatataagatgaatttgtttaaagttttaaaagataactttaaaataaacattttttaagtaataaatatgggccaatttgtttaaacttgaaaaaataatttaaaaataagtacttttttaaataagtagatagaatttgtgtcagtttgtttaattttatttattgaaataaatgcttattttattaaaataaataactttctatttttttaatgtgttttcctaaattatttctacttgttttaaaaagaaaatatttgcaaaaagacatttatataaaaaaattatttttaagttttttaaaaaaatttaaacaaactcaccgtttgtttcttcaaataagcggatttttttaaaaatagaaacagttaaaaaaaataaaataaacataaaaataaatattttattaaaataaatacttattttaacaaataagtttaaacaaattatcacatgatttacttcttaaaaaaacaaaaaaaaactgtttattttaagtaaaaaaagtctagacaaacacatgataaaatcataaaactacttattttatttttaaaaaaatacttattttaaaaatatgctttaaaataattagctcataatttgcatcaaaaatcacaactcacgaattgggagtgaataaattaatagtaattagcttggctctttttcttattttttactccctattttccttttttataaggcttactagactcttttgcatgaccagcgtctctggtcaaaagaattaataataataataataataaaattcattaaaaatcacattaaaagaatattaataatcacattaaaaacatatttaaaatcacattaaagcacattaatgacattttcaatagtactaagaactctttcaattcttgaaccaatattactcttatcttaatggaaaatactctacacttatccgaacgaaaaaactgcaaaagagaagaagaaatgaatggagtgacacgcacaaattaatttcaagataccagcacttagcaatttagcatttgtttggtagccgtcattcgttgcattgcattgcatttgcatttgcattgcaccgtcaactcgcaaaatatttataagttttatactacaccaaaccaaaaaatatgctgcgtctctttctctctcccctctctagcaattacacctcttttgccctccattaaatgcaattgcaccctctcaatacgctctgcaattactcttcgctgccacattttcctccatctgttccccacttctctctctccttcaatgcccttgtccctctctcttcttcttcttcttcttcttctcactttctctctgtaacaccttctcttcatgatatagcttcttcaccttttttttctttcttttctttgttaccatatataagtaaactagattccataactgtcccaagcccttccttcaaaagggtcctctcttttcaacccaaaacagatctacaccttcatcttccaccaccactctcactggtaagtgctaaaaaatattgataataaaagcttctgtcgcaaccagggtcgcggcgtgtttgtgtggaacattcatgttttgttaaggttctctaaggtcacatttgtttttttttttttttaaacgaaactaatgaagctgtttggtacattttgtgagttctactaacattttccgggtgagtcgcttgcagctagggctgtgagaaaaggaacgttattaggtctgtaagaaaaaagaaaatatcctgaaatataggatgcgttgtaggattctccgagatcttcgtgttgttttattttataaataaaaaagttttgattttgttttgtgaaaaggcaaaagatcagataagggttacaatatttcttttcttttttattctgtttacatatattgatgatatatatatgcatagcgtatatttgtttcgaaattttgataagtttttatctttttaattttttttcggccgtttgtataactgagttttgtagtaacacactgactcgctttgacattgtcatctgacagaatccaagggctcaacctcttaagctttttctctatccaagaacctcttaagagagagaaagaataagagaaagagaaagtgagagagccaattctacatttgttggtggtggtttttgaggcatgtgaaat

SEQ ID NO: 77 - DNA, 3000 bp, Sorghum bicolor
ttcactactttattattttctgagcaggaaaaagttatgtttcctttgcaaaaaatgggacccacacgcacggcaagaagccgtgccgtgccgtgccgcggcatggaaacagtactacactccaggactgcatgcactccgttgcagtgaaccatgcatcgatctcttcgcccgttcctctggaaactcataacttttttttttaaagagagaaacccctcaaacaaattaaattggatcatttgcacggatttcatcttgccggtcgtctgttgtgtatactgcaaatgagaattacgtattttgtggaagtccttcgtcttgtttttttatccttggccttgtttagtttcgaaaaatttcggatttcgctattataacactttagtttttatttgacaaatattgtctaatcatgaactaactatgatcaaaagatttatctcgcgatttacaaacaaattgtgtaattagtttttatttttgtttatatttaatgatttatgcatttgccgcaagattcgatgtgacggagaatcttgaaaactttttggatctctgagggaactaaacaacgcccttgtctaacacatgtatccccaatttcatcttgacggagggatataacgatcgagtcaaacctctgcatggatgggtgcactattggcgtgtagcagtatatggcgccaggaaaaagttaaaactaaagaaatggatcttttaacaagtactccctccgtcagcaacatgccggagctgtgtttaaagttagttttaatgaagttttattaaagttttatacatattaaatatgctgatgtaacattgtattgatgaagagagatgataaaaattttatgagataaagttttattctaataaaactcttctgcactatttctaaatatgactgcgttaaaaattgagtcatgaaatccgccgtcgaggatggcctaaagggcactcacaatgcagactctatcatagagtctaaggttatttattacctcgaacaatgtggacttagagtctaaataagacttggagtcttattttttctatctttttcttcaataaatataatgacatatcaacaaaatatcataaataatatgtaattaattgtcttagactctatgatagagttttgcattgtgaggctagtctcaatgcatgtttcatgagagtgtcatgcacattaaatagggtgtcacataagcaaaattgctgacttggcagggtcattaaatgaaggagtttcatcagatgagagagaagtttcatcctcatgaaactcatatggctcgattatctagtttatagtcttggtaactgtaccatgaaactatacattgacactggctgagtgtcctagcatggctcttatcctttggccagaactgaagagacgctatgtatatccatggctatctggaactttcctctctccatcactcagtaattacgccggttatctaatctgaaacatttgtcaatgtactgagtattcagcagaaaacgtaccacctgccgaagtactatatcgtagccgcgattaattgactaataagacaattgaaaaatagactgatattaccctcttagcctataaaagaatgtaactatgaaaccggtcaaactaatttaaatttaattagatttatagtaaataatattagtatttatatctttaaataaatttataataaaactgtattctataacaaacatatattctataactaatttaataatatttattttatataataatagataacattttttatataaatttagtcaaagtttaaacgatcgatctcgttacttaaaaaataaggagtagttagtatttttttattcgagttacagtactaaatgatatataagtctatctctacatggaaatgcatgatcatcgacttgccagcctttattttctcctctccttcatgatgactatacatagctcgaaaataaattaatatatatgtcatgcagatacatgaacgttcattttcacattcatttgccaaaaaaactacatatgacgacgtccaataaatccaaaacacatgacatatcgtgcatgtttctccttatatacaagtactataccaggccttgtttagttccaattttttttgcaaaatagaaatagtagcactttcgtttgtatttgataaatattgtctaatcatgaactaactagtctcaaaatattcgtctcgtcaatttcgtccaaactgtgcaattagtttttattttcgtctatatttaatacttcatgcatgcgtctaaagatttgatgtgatggagaatctgaaaaattttgcaaaattttttgggaactaaacaaggccccaatatacttgtagaaatagaaatatataataataaaaaatcatgcatccgtctctctctcgctctgctagcaattacgatacggcctctcaataaatgcggattgcaccacctcaacactcgtccgcaataactccttcctcccttctccacattctcttccacctccgtccgttcccctccccttcctcttcctctcctcccccttccatggccgccgcttagcttcgttctcaaggcctcctccctctcgccacacacctcctgctagctacccttctgagcttgcaaagttttgccgcatcacatcgatcttgagagctgcagcaggcagagatcgatcagagttctatttttgcagaggcacacaaacatatatagttcctgtatctgctagatctcactgccagccagctcgcagtgaagcttctctgggctaccttgtcgctagatctgttgctggtcgtgctgttacttggcaggcaaggtatacatctccatataggaataggattggcgccgcctgttttcttgggttgtgagggagatatactacgcatgtgccagtgaataaatgggaagcagctagtgaggaggcaataagaatcagggtttgagaggtcgcgagaggagaaa

SEQ ID NO: 78 - DNA, 2500 bp, Sorghum bicolor
ttcactactttattattttctgagcaggaaaaagttatgtttcctttgcaaaaaatgggacccacacgcacggcaagaagccgtgccgtgccgtgccgcggcatggaaacagtactacactccaggactgcatgcactccgttgcagtgaaccatgcatcgatctcttcgcccgttcctctggaaactcataacttttttttttaaagagagaaacccctcaaacaaattaaattggatcatttgcacggatttcatcttgccggtcgtctgttgtgtatactgcaaatgagaattacgtattttgtggaagtccttcgtcttgtttttttatccttggccttgtttagtttcgaaaaatttcggatttcgctattataacactttagtttttatttgacaaatattgtctaatcatgaactaactatgatcaaaagatttatctcgcgatttacaaacaaattgtgtaattagtttttatttttgtttatatttaatgatttatgcatttgccgcaagattcgatgtgacggagaatcttgaaaactttttggatctctgagggaactaaacaacgcccttgtctaacacatgtatccccaatttcatcttgacggagggatataacgatcgagtcaaacctctgcatggatgggtgcactattggcgtgtagcagtatatggcgccaggaaaaagttaaaactaaagaaatggatcttttaacaagtactccctccgtcagcaacatgccggagctgtgtttaaagttagttttaatgaagttttattaaagttttatacatattaaatatgctgatgtaacattgtattgatgaagagagatgataaaaattttatgagataaagttttattctaataaaactcttctgcactatttctaaatatgactgcgttaaaaattgagtcatgaaatccgccgtcgaggatggcctaaagggcactcacaatgcagactctatcatagagtctaaggttatttattacctcgaacaatgtggacttagagtctaaataagacttggagtcttattttttctatctttttcttcaataaatataatgacatatcaacaaaatatcataaataatatgtaattaattgtcttagactctatgatagagttttgcattgtgaggctagtctcaatgcatgtttcatgagagtgtcatgcacattaaatagggtgtcacataagcaaaattgctgacttggcagggtcattaaatgaaggagtttcatcagatgagagagaagtttcatcctcatgaaactcatatggctcgattatctagtttatagtcttggtaactgtaccatgaaactatacattgacactggctgagtgtcctagcatggctcttatcctttggccagaactgaagagacgctatgtatatccatggctatctggaactttcctctctccatcactcagtaattacgccggttatctaatctgaaacatttgtcaatgtactgagtattcagcagaaaacgtaccacctgccgaagtactatatcgtagccgcgattaattgactaataagacaattgaaaaatagactgatattaccctcttagcctataaaagaatgtaactatgaaaccggtcaaactaatttaaatttaattagatttatagtaaataatattagtatttatatctttaaataaatttataataaaactgtattctataacaaacatatattctataactaatttaataatatttattttatataataatagataacattttttatataaatttagtcaaagtttaaacgatcgatctcgttacttaaaaaataaggagtagttagtatttttttattcgagttacagtactaaatgatatataagtctatctctacatggaaatgcatgatcatcgacttgccagcctttattttctcctctccttcatgatgactatacatagctcgaaaataaattaatatatatgtcatgcagatacatgaacgttcattttcacattcatttgccaaaaaaactacatatgacgacgtccaataaatccaaaacacatgacatatcgtgcatgtttctccttatatacaagtactataccaggccttgtttagttccaattttttttgcaaaatagaaatagtagcactttcgtttgtatttgataaatattgtctaatcatgaactaactagtctcaaaatattcgtctcgtcaatttcgtccaaactgtgcaattagtttttattttcgtctatatttaatacttcatgcatgcgtctaaagatttgatgtgatggagaatctgaaaaattttgcaaaattttttgggaactaaacaaggccccaatatacttgtagaaatagaaatatataataataaaaaatcatgcatccgtctctctctcgctctgctagcaattacgatacggcctctcaataaatgcggattgcaccacctcaacactcgtccgcaataactc

SEQ ID NO: 79 - DNA, 1204 bp, Arabidopsis thaliana
atatcggttgttgacgattaaccatgcaaaaaagaaacattaattgcgaatgtaaataacaaaacatgtaactcttgtagatatacatgtatcgacatttaaacccgaatatatatgtatacctataatttctctgattttcacgctacctgccacgtacatgggtgataggtccaaactcacaagtaaaagtttacgtacagtgaattcgtctttttgggtataaacgtacatttaatttacacgtaagaaaggattaccaattctttcatttatggtaccagacagagttaaggcaaacaagagaaacatatagagttttgatatgttttcttggataaatattaaattgatgcaatatttagggatggacacaaggtaatatatgccttttaaggtatatgtgctatatgaatcgtttcgcatgggtactaaaattatttgtccttactttatataaacaaattccaacaaaatcaagtttttgctaaaactagtttatttgcgggttatttaattacctatcatattacttgtaatatcattcgtatgttaacgggtaaaccaaaccaaaccggatattgaactattaaaaatcttgtaaatttgacacaaactaatgaatatctaaattatgttactgctatgataacgaccatttttgtttttgagaaccataatataaattacaggtacgtgacaagtactaagtatttatatccacctttagtcacagtaccaatattgcgcctaccgggcaacgtgaacgtgatcatcaaatcaaagtagttaccaaacgctttgatctcgataaaactaaaagctgacacgtcttgctgtttcttaatttatttctcttacaacgacaattttgagaaatatgaaatttttatatcgaaagggaacagtccttatcatttgctcccatcacttgcttttgtctagttacaactggaaatcgaagagaagtattacaaaaacatttttctcgtcatttataaaaaaatgacaaaaaattaaatagagagcaaagcaagagcgttgggtgacgttggtctcttcattaactcctctcatctaccccttcctctgttcgcctttatatccttcaccttccctctctcatcttcattaactcatcttcaaaaataccctaatcacattttgtaacaataatacaattatacattaaaactctccgacg

SEQ ID NO: 80 - DNA, 2605 bp, Arabidopsis thaliana
tgaccaaattctagaagtgacttgataacatgagaggctataaagctggttcctccggtaaccaagtactctgccattttattaggctcctctgattttgtgtaacattgacaaactagatcatgcgattagatggtctaattttattttattttgtgttagaaggatgttcaatcctggttgatttagtttatgtttgacttttttttatgtagtctttgaataatagtagttacatctaactttcataaagacttggattagtataacctaattataagctttgggcttgaagcaaatataatgaactgaatgtgggcttttaaagtatccaaagaggtttatgaaatgtgatatattttttttggtcttcaatctcttgaaaattggttagcaatccattggcagttgaaggctctctcagagaccttgactagaaggcctcaaaggcaaaggaaggtggaaggaaaaatcaaaattcccggagctgaaagttgacacaaaggaatcaacctagttctttcttgtcttagcttttttgaagggaaatgaaaattgacacaaaagaaggtggaaggaaaaatatgatgcttgtcctttattggacatatcattttgcagaatatatattcttcctagcattttgcatgcattgtgtctaggttgtcatgttgtggctggtttactaagttcctagtacaatgaacaaagcgccagagctgaaagttgaaataacaatcgtcaacatcccaaccgccttaacattaaaaccaaccaaaaaaacaaaaacacatcccaaccgaaagcagcaatccaggaagattagtttatgtaaatgacaaacataaatatgaaaccgtcacatagttgagagtcgccgtgaatatttactttttaaataaaaagatatggttagccgctggttggtctgacaccccatgtatcattatactcattatccgtatgaaggaccattttttcatataaggatatacacgtttgtaacgtatgcagagccaacaccaagtatataacttgtactgtcgtctctgattctgttaaagcggttaactagattattgactatgataattcaatgtaacaccaatttatgccccggacaaaaaaaaaatggtgaaaccaaaatatttgatttgcatcccagttactatttccctgcaatgatatgggggcggcggtttggagatatcgccaatgccacaatttgtcgtaaaaacagttaaacattttactcactagtcactccccacaaaaaaaacgatacttagttccactctctactactacaaaacttgtatacattaaaaaacgatttttattgagtagacattaatgatcggcttataagtctaaacaagtaatgtgacagaattcacgtgaacaaatgctcgagtgggatgtttttattgcttctcaagttggtgatctttaatatcgccaagattaggttgtgcattaaatttggattactttttataaattaaatcaagatatggatatgataaactttctctcttttcttttagttaacatactttatagactttatactacattagattaattgcagatttaaacaatgtttaaaattacaaaaacgttaaatgtcatattttccatataaattttgttttacgtaaaagcaatttacatgaattttgataaaatcatgaaaaaacagaagcggtgtccaagattggggatgaatgagaaaacaccgcactgatagtaactgaaaagaatgtaaccagtctcacgatggggatggcggagagaaagagagagacaagacagtagagaaaagaaggtacgacggagagatgaaggttggacagagagaacaaaacgagaacggcaatggccgggaaaaaaggagagtagggaggaaaaaaaaaagaattttgtttttttagcttttgtagggttttttgttagtcgtaaaatataaattataatatcaaagaaaataatgagttaattttaaagaaggttagatgatatttttcacaagtttttgttgatatagtaaacccacaattttattttgtcattcaaagtaaattttcaacaaaatatagctgttgctggtcacattttaacgggaaaaaataattcttgtacctggatgtataacctctgaaccttgtattacaaatttacaaaacacattgatctcaatcagaccgaacatgtatatcgagtcaactgacaaatctcttttcctactcttgttacatattctttctaggaaaaaaaaatgctttcaggctcaatgaaatgaattaaaacagcaaaaggttggtaaaagtctttttccccataatcatttgctccataattgacgtttgtctggcaacaactggaaacacagatatagaaaaaaagattggacagtaaatcataaaaaaaaaaaagcaaaattaaatagaaagacgaagcgagagaaagagcgttgagtggcgtgagagtttgagtccgaaaattaactcctctcccatctgccaactttcctctgtttctcctttatatcccaaacctattcttcctccacacctcatcataggcatagcaaaactcttccaaa

SEQ ID NO: 81 - DNA, 2500 bp, Arabidopsis thaliana
tgaccaaattctagaagtgacttgataacatgagaggctataaagctggttcctccggtaaccaagtactctgccattttattaggctcctctgattttgtgtaacattgacaaactagatcatgcgattagatggtctaattttattttattttgtgttagaaggatgttcaatcctggttgatttagtttatgtttgacttttttttatgtagtctttgaataatagtagttacatctaactttcataaagacttggattagtataacctaattataagctttgggcttgaagcaaatataatgaactgaatgtgggcttttaaagtatccaaagaggtttatgaaatgtgatatattttttttggtcttcaatctcttgaaaattggttagcaatccattggcagttgaaggctctctcagagaccttgactagaaggcctcaaaggcaaaggaaggtggaaggaaaaatcaaaattcccggagctgaaagttgacacaaaggaatcaacctagttctttcttgtcttagcttttttgaagggaaatgaaaattgacacaaaagaaggtggaaggaaaaatatgatgcttgtcctttattggacatatcattttgcagaatatatattcttcctagcattttgcatgcattgtgtctaggttgtcatgttgtggctggtttactaagttcctagtacaatgaacaaagcgccagagctgaaagttgaaataacaatcgtcaacatcccaaccgccttaacattaaaaccaaccaaaaaaacaaaaacacatcccaaccgaaagcagcaatccaggaagattagtttatgtaaatgacaaacataaatatgaaaccgtcacatagttgagagtcgccgtgaatatttactttttaaataaaaagatatggttagccgctggttggtctgacaccccatgtatcattatactcattatccgtatgaaggaccattttttcatataaggatatacacgtttgtaacgtatgcagagccaacaccaagtatataacttgtactgtcgtctctgattctgttaaagcggttaactagattattgactatgataattcaatgtaacaccaatttatgccccggacaaaaaaaaaatggtgaaaccaaaatatttgatttgcatcccagttactatttccctgcaatgatatgggggcggcggtttggagatatcgccaatgccacaatttgtcgtaaaaacagttaaacattttactcactagtcactccccacaaaaaaaacgatacttagttccactctctactactacaaaacttgtatacattaaaaaacgatttttattgagtagacattaatgatcggcttataagtctaaacaagtaatgtgacagaattcacgtgaacaaatgctcgagtgggatgtttttattgcttctcaagttggtgatctttaatatcgccaagattaggttgtgcattaaatttggattactttttataaattaaatcaagatatggatatgataaactttctctcttttcttttagttaacatactttatagactttatactacattagattaattgcagatttaaacaatgtttaaaattacaaaaacgttaaatgtcatattttccatataaattttgttttacgtaaaagcaatttacatgaattttgataaaatcatgaaaaaacagaagcggtgtccaagattggggatgaatgagaaaacaccgcactgatagtaactgaaaagaatgtaaccagtctcacgatggggatggcggagagaaagagagagacaagacagtagagaaaagaaggtacgacggagagatgaaggttggacagagagaacaaaacgagaacggcaatggccgggaaaaaaggagagtagggaggaaaaaaaaaagaattttgtttttttagcttttgtagggttttttgttagtcgtaaaatataaattataatatcaaagaaaataatgagttaattttaaagaaggttagatgatatttttcacaagtttttgttgatatagtaaacccacaattttattttgtcattcaaagtaaattttcaacaaaatatagctgttgctggtcacattttaacgggaaaaaataattcttgtacctggatgtataacctctgaaccttgtattacaaatttacaaaacacattgatctcaatcagaccgaacatgtatatcgagtcaactgacaaatctcttttcctactcttgttacatattctttctaggaaaaaaaaatgctttcaggctcaatgaaatgaattaaaacagcaaaaggttggtaaaagtctttttccccataatcatttgctccataattgacgtttgtctggcaacaactggaaacacagatatagaaaaaaagattggacagtaaatcataaaaaaaaaaaagcaaaattaaatagaaagacgaagcgagagaaagagcgttgagtggcgtgagagtttgagtccga

SEQ ID NO: 82 - DNA, 3455 bp, Glycine max
gagtatttattgagagaatacttgcgagattctttttaatatgttatttactaattattattatttaaaatttattagaaatattttttaaatctcatttcttctattaattttaatcaataaaaaagaaaaaatatattaaaaagtatgctacatatctcatttgttaaaataagagtttattaacttaggagagttttcataagttcacaatttaatttgattctgaataaaaaaaaaagcttatagaatatttgtataactaattaagtctaaataaattttacataaattgtttcaaaccctctaatatatgcactagctcctaactatcttttattatatttaattgcaattttaatgaaatcctcttttgtttcagaagcttatagaataattattttcatttaataaatggtttttatgattctgatgtaatattttaattattttctctctctctctctctctctccctatatatatatatatatatatatatatatatatatatatatatatatatatatatatatatatatatatatattctcctaacaaacctttaaggatttatccaccgctgcatatgccaggctgaaaaacaattatttcattttcgtgggtgtatatataaaaaaaacttgtggaataagagaggtgttgatcgatgagctgtaataaccttcaatcttgagcttcaaacaaactcaagttatggtcttccctatagctagctaatattttttggtgttgatagctagctaatattttggactgcactgtttacactcaacagttcaatttacaccaacttaaccaacaaatcttccttcgattttctgctgcccattgaaactctgcatgtcaaaatgctacttgtcacaaataaaaaaggttgagaaaaaggataataagggaataacaacaatatatacaacatgagcatccgtttactatacgctgcttaatgtcatgcacagtacttatctaagcaaatttttttgacaagatgtgaatgatgtaacaataaacatttcatctctttctataatatatacttagttaggttattatattcgtacaatcagcttctgtatcattttatttccactctcttttttatcttgttttttttcatttctcatcatatttaccaattttttgataaaaaataaccatatttaccgatttttctctctttaatttatttttattttttttatccctctatgtttatctttcttgcacagttgcacttgtaaataatacccttataacttttttcctatatactttcgcaattataatacgcggtttgtctgtccgttgactgttgctatatgtagtatatagcagtacttatttatttattttatcagtacagtacttatttatttcagtgtacgaaagcggttgtttttattttcagatttaaatttgaattcaacctcgtcataatccccaatccaagaacaaagacaaaatttagaagggtacggagaacttaaagtctcacaaatccttttttaattccggatatccacaaattaaccggaagtaggactaattcctgaaaatattaaaatgtatttagtttagggaattaattttttctataaatatttttaatttaatacatatagatgtcgaaattatattaaacctctaattacaaacatataatgatattgagatatacatgattgatcaggagttaaaaatataaaaacaaaaaaagtgaatgaagaaaaaaaaaagaaaataaattgtgagtttaaatttttccagtgatattttaaaaaaataataataaattaatatttatcgtcgataatattagtatctcttactccccttgctctataggctcgaacttattatgattgatggttgtcattcatatgttccactaataaaaggagtaagattgacaaatgaataactagttaaggtgagtgcattaaatcagtaagatacaatactcgttataaattattaaatgaacgaatagtcaatgcttgactgttgacaacctttgaatagtcaatgttatctatttatccttagatggactttggcaacattgatgttaatccagagtggaatgtaaagttttaacgcatagcatgtctaaaatgatatgtatgtagtgtagaatctttatatgtgttatttttttttataaagatgaataatcaataataaagtttatgactgttttccattgatgttatgataaaattaaataaataaatccaaggcaatcacttcaaagacgttataattagacaatatcagcttcttcttctttttttctaaaaatgataaggataaataagtatgaattaatcataacagcacatctttttgtactaaaagatgattcattttaaaaaggtaagcattacgttacgaataaatttgttttcatgatattttgtttgtatgcaacatatttttcaatacaaaaatatttttatataattcaaactaaacataattttaaaattattttttagctaacacaataaaatttatataattaatttaaaaaataattgtgaacaaaataaatcagtaaataattttttcattataagatagcctaaaattattttttataagatttgtgtaaaaataatatataataaaagaaaatatgttaaaaactgagcaatgctattgggtacaaatagcataaacacaaaaccaaacgactagaaacgtgacttaatattatttttaaaaaatatatatattaattaacttttttcataaatataaaataggttttggtagaaatcacagttgatgcaaaaccaattcgtacaagacagcattttcctttaaaaaaattgtgtatatttgcctcagccacacgaaagcctaattaataagttatctcattttggaagtacgttgtatctacatgtgaacgtatttaaatgtaactaaatccatgtttaatgaaactttcggcgttgatctgacacatggttttattttaattttttttcgtttggatccatgagattgaggtgtgggtgcactttttttggtttgtgttttattatcattgttataagatcacacagacgcacgtacggagaggagagatatagaagtagttgcaattgcaaagaaggccgtgtcccaatttccctttgaaagcacaaatttaatgatgaaaggaagagaagaaataaaagtatgtttacgggtgttagggtttagttagatgtggaaggggtggagttatgaaaattaataccaagttaagtgagcgttgagtgacgtgaagtcttacattaatacctctcatctgccccgttcagaccttagggtcccttggcctttaaaacctcaccacccctacactgagttattatcattcaagcaccattcttctcgatcttctctttctcaaccgaaccaaattacagatttaacaag

SEQ ID NO: 83 - DNA, 3000 bp, Glycine max
gagtatttattgagagaatacttgcgagattctttttaatatgttatttactaattattattatttaaaatttattagaaatattttttaaatctcatttcttctattaattttaatcaataaaaaagaaaaaatatattaaaaagtatgctacatatctcatttgttaaaataagagtttattaacttaggagagttttcataagttcacaatttaatttgattctgaataaaaaaaaaagcttatagaatatttgtataactaattaagtctaaataaattttacataaattgtttcaaaccctctaatatatgcactagctcctaactatcttttattatatttaattgcaattttaatgaaatcctcttttgtttcagaagcttatagaataattattttcatttaataaatggtttttatgattctgatgtaatattttaattattttctctctctctctctctctctccctatatatatatatatatatatatatatatatatatatatatatatatatatatatatatatatatatatatattctcctaacaaacctttaaggatttatccaccgctgcatatgccaggctgaaaaacaattatttcattttcgtgggtgtatatataaaaaaaacttgtggaataagagaggtgttgatcgatgagctgtaataaccttcaatcttgagcttcaaacaaactcaagttatggtcttccctatagctagctaatattttttggtgttgatagctagctaatattttggactgcactgtttacactcaacagttcaatttacaccaacttaaccaacaaatcttccttcgattttctgctgcccattgaaactctgcatgtcaaaatgctacttgtcacaaataaaaaaggttgagaaaaaggataataagggaataacaacaatatatacaacatgagcatccgtttactatacgctgcttaatgtcatgcacagtacttatctaagcaaatttttttgacaagatgtgaatgatgtaacaataaacatttcatctctttctataatatatacttagttaggttattatattcgtacaatcagcttctgtatcattttatttccactctcttttttatcttgttttttttcatttctcatcatatttaccaattttttgataaaaaataaccatatttaccgatttttctctctttaatttatttttattttttttatccctctatgtttatctttcttgcacagttgcacttgtaaataatacccttataacttttttcctatatactttcgcaattataatacgcggtttgtctgtccgttgactgttgctatatgtagtatatagcagtacttatttatttattttatcagtacagtacttatttatttcagtgtacgaaagcggttgtttttattttcagatttaaatttgaattcaacctcgtcataatccccaatccaagaacaaagacaaaatttagaagggtacggagaacttaaagtctcacaaatccttttttaattccggatatccacaaattaaccggaagtaggactaattcctgaaaatattaaaatgtatttagtttagggaattaattttttctataaatatttttaatttaatacatatagatgtcgaaattatattaaacctctaattacaaacatataatgatattgagatatacatgattgatcaggagttaaaaatataaaaacaaaaaaagtgaatgaagaaaaaaaaaagaaaataaattgtgagtttaaatttttccagtgatattttaaaaaaataataataaattaatatttatcgtcgataatattagtatctcttactccccttgctctataggctcgaacttattatgattgatggttgtcattcatatgttccactaataaaaggagtaagattgacaaatgaataactagttaaggtgagtgcattaaatcagtaagatacaatactcgttataaattattaaatgaacgaatagtcaatgcttgactgttgacaacctttgaatagtcaatgttatctatttatccttagatggactttggcaacattgatgttaatccagagtggaatgtaaagttttaacgcatagcatgtctaaaatgatatgtatgtagtgtagaatctttatatgtgttatttttttttataaagatgaataatcaataataaagtttatgactgttttccattgatgttatgataaaattaaataaataaatccaaggcaatcacttcaaagacgttataattagacaatatcagcttcttcttctttttttctaaaaatgataaggataaataagtatgaattaatcataacagcacatctttttgtactaaaagatgattcattttaaaaaggtaagcattacgttacgaataaatttgttttcatgatattttgtttgtatgcaacatatttttcaatacaaaaatatttttatataattcaaactaaacataattttaaaattattttttagctaacacaataaaatttatataattaatttaaaaaataattgtgaacaaaataaatcagtaaataattttttcattataagatagcctaaaattattttttataagatttgtgtaaaaataatatataataaaagaaaatatgttaaaaactgagcaatgctattgggtacaaatagcataaacacaaaaccaaacgactagaaacgtgacttaatattatttttaaaaaatatatatattaattaacttttttcataaatataaaataggttttggtagaaatcacagttgatgcaaaaccaattcgtacaagacagcattttcctttaaaaaaattgtgtatatttgcctcagccacacgaaagcctaattaataagttatctcattttggaagtacgttgtatctacatgtgaacgtatttaaatgtaactaaatccatgtttaatgaaactttcggcgttgatctgacacatggt

SEQ ID NO: 84 - DNA, 3138 bp, Populus trichocarpa
aaaaaggaaattaactaatattatatatatagtgaattcttaaaaatacgtccctcaatatgataaacattgttatatcgatcgggaaatatagttttagtgttcctagtatttttaaaaagaggtgccttcgtccaactaatcaaaatacgagagtcaaactatgagagttacatataatttggtgtcagagtagaatggcatgaagttatggctgctaaactttagctgactgtctgtttcatagcctaatttagccaacacctcaagttcctctctcctgatggcatctgctgctatctctatcctcatagcttttaacccatatcacatgttttcaaggtaccagagaggcggtggcttgatctaagaaatttaatcttaccggtaatttgcaatttatttgcatagttgatttcaattaatattgatgtcatactataaccggacttactaaatatattaccagggtctaaaatgcataccaccatcaccaggaccggaattaagggccggctcctgcaatgaaattttttccagtatttttcatttaataaattagatttttagttttaaaaataaaaaataattttttttaatttgaccagctcaaaataaaattaatagcttcgccccttatcctcacctcgacatttgtctttgtaccagttaccaaagacatcacggcaggattcgaggctggtgaagagagaagattaaagaaaggtgtacctcaaggagggacgatgagtaaattaaatatatttattttggaatttttaaattcatgagcacacgaggcgcgacggctcttattaaatttttcgtacttaccatggagaaaaaaaaaacaaataaagtaataaatgtataagcgagacgtacctttttggttcctgcactacaactgtttttgaagcacaaaatattattttttttcctttcaacgtaaaacaccaattcctttaaaaggaaacaacttttcttcgaatataaaacaggggtttaaagcaacgcaactcgttgagattctttcaagtttgtgcagtgcagctcatgatggtagtcataacacaacagtcctggatccaactacatttataattaagttctctctttggttgaccagtgagaatcattgagaaatatcaaaacgagtttttaaaaaaatgaatatgaaaacaaatgctccgctttgacttttctttacttttccctgctttaatggataggggtatcaatttgtccagttgcagttgtggaagtaaaatacaattatgtaacattttagttgttttttaaaatgtttttaatttaaaaatatattaaaatattttttattttaaaaaaattatttttaatactaacatattacaaccagatacaaacatgaaaaatattcttaaacaattctttttaattttttaataaaatattatttgaaatacaatactgtaacattttagttgaaactctattttctctacaaggatgcatggatacttttttttttaactaattgagtgtataacagtaattataattttttaaaatattttttatttgaaaatatattaaaataatattttttattttttaataaattatctttgacatcattatattaaaacgatttaaaaaaataaaatttaataaatcagtgtttgaaatgcgtttaaatatctctttggcgcggtcagccatagctttccatgcattaaactacaggcgaggacatcagacgccagttgttatataatttttggacataaggtgacaaatcttaatttccccaccacatgcagtactattcttctttcctttcgatcttgtgctaattaactagtcacatgttttgcttaattaaattgaagtgtcaatttcattttcatgttaaattaatttgttgtcggttctatatataacaaaattatcccttctgtttgtaagtattgaattttttacaagatttatttatttaaatacaaattacttttatttgaaatcttttaattatatatattcctttgttattgaacatgaatccaacatagattcatgggaattaggtccacgagaatatattagcccctagctataaacgactgagaagatacattttactaacccccctctcctctagtggatgcgatcaggttcaagtaaaactgattacagtgatacaatttcaaatgcttctggatctttctcccctttcactcataattaatttttctaatccctcctttttcttattataaaatgtatatgtcatcaaatttgaaaatatgcatataccaaacatcattaaaaataactattttattttgtaatcattcctttgttgattttttagctcaaaacaaacaaattctaaacgtgattactacgattcaacttcaatacagatgttacttgaaattctgctagattacttaattaatagtttctagctaaattatccatatatatctcttgatttataatttctgattaataaaaacagtgatcatttgatttggagcacacaataacaaatatgctattgatgagtgaaaaaaaatagccgagagaaatataaacaaagttattaaatttggttctatttagaactccactagagattcaagtcaatcaaaaaaatgttattttaatttaataaaaataaaactaaattttaatcagttcattaattaattcattgaattactcatttgattagttgcaatctcaccaagttttttttttaaaatccgacacagcaataacaaaggatattggacagggaagggtactccgaacccgtacctggtaggatgtctagttacacccggagagaaaagaaaagaaaaggccagaaaaaattaatagatatattttttttttttggtgtaagaaaattaatagagttaagtgggcgttgagcgcctcattaatcttctcatctgcctccatcattgcccacggccccgtgcctttatatctcccatcctcccgcctccccccctcacctaatatcatcaactctctttctctcaagcaacaaccatacactcatctcttctcgtctccctctctctccccctcagtacactacattcctcaacatttcttcttcttcttcttcttggcaaaata

SEQ ID NO: 85 - DNA, 3000 bp, Populus trichocarpa
aaaaaggaaattaactaatattatatatatagtgaattcttaaaaatacgtccctcaatatgataaacattgttatatcgatcgggaaatatagttttagtgttcctagtatttttaaaaagaggtgccttcgtccaactaatcaaaatacgagagtcaaactatgagagttacatataatttggtgtcagagtagaatggcatgaagttatggctgctaaactttagctgactgtctgtttcatagcctaatttagccaacacctcaagttcctctctcctgatggcatctgctgctatctctatcctcatagcttttaacccatatcacatgttttcaaggtaccagagaggcggtggcttgatctaagaaatttaatcttaccggtaatttgcaatttatttgcatagttgatttcaattaatattgatgtcatactataaccggacttactaaatatattaccagggtctaaaatgcataccaccatcaccaggaccggaattaagggccggctcctgcaatgaaattttttccagtatttttcatttaataaattagatttttagttttaaaaataaaaaataattttttttaatttgaccagctcaaaataaaattaatagcttcgccccttatcctcacctcgacatttgtctttgtaccagttaccaaagacatcacggcaggattcgaggctggtgaagagagaagattaaagaaaggtgtacctcaaggagggacgatgagtaaattaaatatatttattttggaatttttaaattcatgagcacacgaggcgcgacggctcttattaaatttttcgtacttaccatggagaaaaaaaaaacaaataaagtaataaatgtataagcgagacgtacctttttggttcctgcactacaactgtttttgaagcacaaaatattattttttttcctttcaacgtaaaacaccaattcctttaaaaggaaacaacttttcttcgaatataaaacaggggtttaaagcaacgcaactcgttgagattctttcaagtttgtgcagtgcagctcatgatggtagtcataacacaacagtcctggatccaactacatttataattaagttctctctttggttgaccagtgagaatcattgagaaatatcaaaacgagtttttaaaaaaatgaatatgaaaacaaatgctccgctttgacttttctttacttttccctgctttaatggataggggtatcaatttgtccagttgcagttgtggaagtaaaatacaattatgtaacattttagttgttttttaaaatgtttttaatttaaaaatatattaaaatattttttattttaaaaaaattatttttaatactaacatattacaaccagatacaaacatgaaaaatattcttaaacaattctttttaattttttaataaaatattatttgaaatacaatactgtaacattttagttgaaactctattttctctacaaggatgcatggatacttttttttttaactaattgagtgtataacagtaattataattttttaaaatattttttatttgaaaatatattaaaataatattttttattttttaataaattatctttgacatcattatattaaaacgatttaaaaaaataaaatttaataaatcagtgtttgaaatgcgtttaaatatctctttggcgcggtcagccatagctttccatgcattaaactacaggcgaggacatcagacgccagttgttatataatttttggacataaggtgacaaatcttaatttccccaccacatgcagtactattcttctttcctttcgatcttgtgctaattaactagtcacatgttttgcttaattaaattgaagtgtcaatttcattttcatgttaaattaatttgttgtcggttctatatataacaaaattatcccttctgtttgtaagtattgaattttttacaagatttatttatttaaatacaaattacttttatttgaaatcttttaattatatatattcctttgttattgaacatgaatccaacatagattcatgggaattaggtccacgagaatatattagcccctagctataaacgactgagaagatacattttactaacccccctctcctctagtggatgcgatcaggttcaagtaaaactgattacagtgatacaatttcaaatgcttctggatctttctcccctttcactcataattaatttttctaatccctcctttttcttattataaaatgtatatgtcatcaaatttgaaaatatgcatataccaaacatcattaaaaataactattttattttgtaatcattcctttgttgattttttagctcaaaacaaacaaattctaaacgtgattactacgattcaacttcaatacagatgttacttgaaattctgctagattacttaattaatagtttctagctaaattatccatatatatctcttgatttataatttctgattaataaaaacagtgatcatttgatttggagcacacaataacaaatatgctattgatgagtgaaaaaaaatagccgagagaaatataaacaaagttattaaatttggttctatttagaactccactagagattcaagtcaatcaaaaaaatgttattttaatttaataaaaataaaactaaattttaatcagttcattaattaattcattgaattactcatttgattagttgcaatctcaccaagttttttttttaaaatccgacacagcaataacaaaggatattggacagggaagggtactccgaacccgtacctggtaggatgtctagttacacccggagagaaaagaaaagaaaaggccagaaaaaattaatagatatattttttttttttggtgtaagaaaattaatagagttaagtgggcgttgagcgcctcattaatcttctcatctgcctccatcattgcccacggccccgtgcctttatatctcccatcctcccgcct

SEQ ID NO: 86 - DNA, 2556 bp, Vitus vinifera
tttttaaaataattatttcaaaaaatatcaacagtgcaattattttttataataaaatttaacatatcatataaaaagctttctttttttaataaaaaattattaattagaaaattattttctgttttgaaattaaaaaaaataaaaaataaaaaaattccagaagagttttgaaacaggaccacatgttaaaggtaggtgcttaaattaaaaattgaatatgatatcgacggtggcagcaggtggagtctgagtgtgagtggggatggccgttggccacataaaattctcagagagttaggtttggttcccatgaaatgaaagtggcctttccatttaacattctacaaggtgtctccatttgcctttgccaccattaaatttagggtttctgggttcatcttctgtccatttcagatgaatgcactctcctctctcccccgtatatcccctctgcacttccatcttaaatgccatattttgtggttcaaaacttgacccccattcatactccaccttcatgtcttgatgctttcttatttttgcactccaaaagaagggaaaaaagagagaagtatgaaacaaaaacgaggcataacatgatcacttcattatataattacccatcaaatatatatttactaaaattacaaatgtcaataacaaaatattagatcgataactgttttcaaaaacagtttttgaaaatagtctttaaaaattattatttcatgtttttataaaataaaattttatttaaaaacttaaaatgtttttaacttgtttttagtatctttaaatatattttaaaaataatttttatatgcctttgtcatttcattttgatgttaatttttatatttgaaaattgttttaattattaattttaatttaatgaaagctcagcccaatctaaaccagcaagatggttgatgatagataataattaataatatataccccaaatcagaataaatctgctagccgttaccctcaaatatttgaagtatccctatacattttggtgatgcaacttgttgtgttgattaggtttttagtatacatggtttaagagaaacaatccttaattagtttatactaaatgatgttatagacactaagtccaccttatgttagaagtactagttttagattagcttaactcaaatgttttatttcaaaagattagagtatgattaagaatgttttttgaaaaactattttataaaatagtttttttaaatagaattttatttgagaatttgaaatatactccgacttgtttttatgtatttttaaatattttttaaaattaatttttatttattatgctttatttttcatcattttttgtatttgtattgttaaaacaatttctagaacaagtaaaaataattaaaatatgtcatttaaaatcattatattttcacaataagttttccaaatattatttttattaaaaaataaaaataataattttttgctcgtaagtacatttgtttttgtgttttttttttcttcaaagaactctttatcatagtatcatgtaagaggtatcattacgttttttttccaagcactcaatgctaacaataccaaaatgtttactaaaaatgtaattttatttgttttttgttttaaaaaatagaaaattattttaaaaagtaattacaaaaaacctatttgacaactatttttaaaaacaattctgaaacttatttttgtataacaaaactctataatatttttaatattcttatatatgttttaaaaataatttttatatctagtatttaaaacaattctaaaaataataataaaaaaaaattaaaattttttttattttttgcttttaataataaaaaacaaaaaataatttttaatggtttagtttgtttttattatgaataatagaaaattattttaaaaaccaattctcagtacaaaatggcccggaatgttcggattgcgttgtacaaaacccatgatacaatcactttctagtttgtagaggtgggatgaggctattaattgcttgggagtgtcattgaaaggatggatcttggcttatgaaatttcaccactttggaagaaaaacaatgaactgatgaattaatttaagtcccaaatcaattaattaaggatgaatattttgaatttacaaggaagggtgctatttttttattagaccaaagtagaaaaatgaacaaataacagtaacccattaaagaggggcatcatgaatatgaaaatgaaaatgaaagagaaaaagagaaacaaggggggagtttagttgattaataatgagggaggttaggaaataaagtgtaggtgagtccaggtgggggagcgttgcgtgagtgtgagctgttcattaaatcctctcatctgccctctatttaattcccactattttagctttgcctttaaatcccacctcaccctcccattttctccctaccactctcttttctctcttctttcatcaacatcatcagctctttctctttctctctttctgtctttctccctcaattcttaattctcactcccaaa

SEQ ID NO: 87 - DNA, 2500 bp, Vitus vinifera
tttttaaaataattatttcaaaaaatatcaacagtgcaattattttttataataaaatttaacatatcatataaaaagctttctttttttaataaaaaattattaattagaaaattattttctgttttgaaattaaaaaaaataaaaaataaaaaaattccagaagagttttgaaacaggaccacatgttaaaggtaggtgcttaaattaaaaattgaatatgatatcgacggtggcagcaggtggagtctgagtgtgagtggggatggccgttggccacataaaattctcagagagttaggtttggttcccatgaaatgaaagtggcctttccatttaacattctacaaggtgtctccatttgcctttgccaccattaaatttagggtttctgggttcatcttctgtccatttcagatgaatgcactctcctctctcccccgtatatcccctctgcacttccatcttaaatgccatattttgtggttcaaaacttgacccccattcatactccaccttcatgtcttgatgctttcttatttttgcactccaaaagaagggaaaaaagagagaagtatgaaacaaaaacgaggcataacatgatcacttcattatataattacccatcaaatatatatttactaaaattacaaatgtcaataacaaaatattagatcgataactgttttcaaaaacagtttttgaaaatagtctttaaaaattattatttcatgtttttataaaataaaattttatttaaaaacttaaaatgtttttaacttgtttttagtatctttaaatatattttaaaaataatttttatatgcctttgtcatttcattttgatgttaatttttatatttgaaaattgttttaattattaattttaatttaatgaaagctcagcccaatctaaaccagcaagatggttgatgatagataataattaataatatataccccaaatcagaataaatctgctagccgttaccctcaaatatttgaagtatccctatacattttggtgatgcaacttgttgtgttgattaggtttttagtatacatggtttaagagaaacaatccttaattagtttatactaaatgatgttatagacactaagtccaccttatgttagaagtactagttttagattagcttaactcaaatgttttatttcaaaagattagagtatgattaagaatgttttttgaaaaactattttataaaatagtttttttaaatagaattttatttgagaatttgaaatatactccgacttgtttttatgtatttttaaatattttttaaaattaatttttatttattatgctttatttttcatcattttttgtatttgtattgttaaaacaatttctagaacaagtaaaaataattaaaatatgtcatttaaaatcattatattttcacaataagttttccaaatattatttttattaaaaaataaaaataataattttttgctcgtaagtacatttgtttttgtgttttttttttcttcaaagaactctttatcatagtatcatgtaagaggtatcattacgttttttttccaagcactcaatgctaacaataccaaaatgtttactaaaaatgtaattttatttgttttttgttttaaaaaatagaaaattattttaaaaagtaattacaaaaaacctatttgacaactatttttaaaaacaattctgaaacttatttttgtataacaaaactctataatatttttaatattcttatatatgttttaaaaataatttttatatctagtatttaaaacaattctaaaaataataataaaaaaaaattaaaattttttttattttttgcttttaataataaaaaacaaaaaataatttttaatggtttagtttgtttttattatgaataatagaaaattattttaaaaaccaattctcagtacaaaatggcccggaatgttcggattgcgttgtacaaaacccatgatacaatcactttctagtttgtagaggtgggatgaggctattaattgcttgggagtgtcattgaaaggatggatcttggcttatgaaatttcaccactttggaagaaaaacaatgaactgatgaattaatttaagtcccaaatcaattaattaaggatgaatattttgaatttacaaggaagggtgctatttttttattagaccaaagtagaaaaatgaacaaataacagtaacccattaaagaggggcatcatgaatatgaaaatgaaaatgaaagagaaaaagagaaacaaggggggagtttagttgattaataatgagggaggttaggaaataaagtgtaggtgagtccaggtgggggagcgttgcgtgagtgtgagctgttcattaaatcctctcatctgccctctatttaattcccactattttagctttgcctttaaatcccacctcaccctcccattttctccctaccactctcttttctctcttctttcatcaacatcatcagct

SEQ ID NO: 88 - DNA, 3000 bp, Sorghum bicolor
tatccccttgatgacgacgagcgttgagcgtgcgtggcagtgattgtctgattgactgatcgagcaagtgtgtatagtagccaactctctctgcatgtggtggcttgcaggacgcacacaactattatagaggccggccgcgcatatatataggtatataggatcagtcaatcagacaatcactaaagatacattgacatgtttgtgtttttcctagaaaatcatttcaaaattttcaaaggaaagccttttaagacaaactagaagttatttattttgatctatatgtatttttactcctacataagaggctacctttatcttccacataaaattttagaagataactttgacatcatggacaagttcgaatagacccatgacggctaatgtgtgatgtgagtctcaccttgggtcttgagagttggttagaccaacatactcccttcatcctaatctataagtcactctaagaatcttgtcaaaacatctcaagtaactaacattatagaaaaaatcaaaaagatttatgacatcaaataaatattactataaaaatataactaatgaagaatctaatgatacttagatgatatcataaatgttattatgttatcatataaatttggtcaaacttaagatacttttgactttctaagattcttggaatgacttataatttaggatggaaggagtatacggcttctagagtccttatcatcaacaccatgctagaccttttacgtgaggggaggatgaaagcataagtgggttgataggactgtggttcgcttagtgtatggtgtgaacccgatagactctagaaacttgtgtatcaatggtcaattatgagtagaaggttccatcggaacaattattatttatttcaagctatttcggctctttcttaatcttcaaaaagaaattaattccgtaatggtaagacgaaaaaagaaaaaaaaataaaaaggaagtgtggaaaaatgacaaaatggcggcacagggaggcgagaaccaccgcttttaggaaataagcctacaatttgattctcgtctcgttttacttgcattttctttcgttcagtctcgttctgagagtggaatcgaaccactcactccgtttggatttagagtccaaagggcccagccagcgaaagaggattgacctccgtggacatgtggtgcatggtacgtgttggcccaatcaatgtagcttgtgacatggcactgcgccattactagatgcatgcacgtgtgtttcaagagggaacattttttgtgaaatgtggttgtattcacatcaatccatgtgtattagggtggattgaagtggaagttgaactaaattttacctcaatccaccgcaacccatgtggattgaggcgaatccaacaacattcaaataaggccttacttggttatgggtgtgttggggagacgttgacatgaggccctttgagatggttgcaacctgggtcaatttaacttaggccatggtggatcatgtgtatgttgaggtgagatcgtgcaggtttggtctcaccttgatcactgagggtggatatagcacatataatgtttttaatctacatcattaactctaggttggcccttttatgtaaagcaaggatgaaagcataaataggttagtgaaagtgtgcgcttaactaagagtgtagagtggatctgagatattgaactctaagcactaaataaccaagttttaacttatgtcaatgttaatttgttagtataaacaataagaatataataagcatataaatattgtaatacaacttaccaccaataactttagtactctactgcaaagtataaagacgttttggcttttctagatatatagtttggttgtgcacttacatatattttatgtctagatatatacatattagaatgtatctagaaaagacaaactatcttacaatttagagtgaagagagtatatatagagatgtaatgatcatcttgcatcattgaaatactatatgacatcaaattattacaaaaacaaaaatatcattggttgaagcttgttgaagatcataaattattatttttgagccctcataaggtacaactgccgtttctaaacatatgcacaaacacaaacactcacgcacgcatacaacacacacccagtgtgcacgacctacaaactatacacacgtagatacgaaccatgttacggtcgacgcggacatgaactgggccttcatgaggggcagcactagatatcactgagtgatctcactgagtccaccccttccccctcctcctgatggcatccttggaccggaaaccatgtcagggctctccgatctttgcttcaaccatggcgtcaagtttgaagcactcgtctcacagcgttttggatgcccagtgagtcccatctctccccagactgttttggatctttgcttcaaccatggcgtcaagttttggatctctccccagcattttggatgcccggtccgctgtccgtctgaatattgattcagtgagtctcatccttcaagcttgctttggtggcaaagaatacaatgttacccatctctctggatggatgttcaaattttcaatatcttgcaaaaatgtggctttcatgattaacaaccttaaaagccactctttcaaaacttttctcatcttctttcacctttggagtggaggaggaccaaattggcgcaaggattttactctctggcaacaggagcaagatgcaaaatggaaccttgttggatccaagtccaagaaatcttatgctgatattgctaaatcaaatatcaaaaaatcagttttgttgcgcttatcttaccccaccaattatgcatccaacttcctggagccccctcgcagagcatctttggctcctgacaggttctcccatcgccctgctcaaaataatgtgatgaaagcacaaattgatagtaaacctgtcaaaggtttgcaacaatctcatcctagtggctttccaagatg

SEQ ID NO: 89 - DNA, 3070 bp, Zea mays
cgggcggagcggagttcgccgtcttccggggcctagcccaagtccgagccctgggtcgggcggaacggagttcgccgtcttccggggcttagcccgagtccgagccctgggtcgggcggagcggagttcgccgtcttccggggcttagcccgagtccgagccctgggtcgggcggaacgaagttcgccgtcttccggggcttagcccgagtccgagccctgagtcgggcggagcggagtttcctatggcgcctttggcaaggcctgactgcctgtcagactcactctgtcgagtggcactgcagtcggagtggcgcaggcggcgctgtccttctgtcagaccggtcagtggagcagcgaagtgacggcggtcacttcggctctgccggggggcgcgcgtcaggataaaggtgtcaggccacctttgcgttaaatgctcctgcgactcggtcggtcggtgcggcgatttagtcatggttgcttctcagcgaaggcaaggcctcgggcgagccggagatatgtccgccgttaaaggggggtctcgggcgagacggaaatctctcggggtcggctgcccttgtccgaggctaggctcgggcgaggcgtgatcaagtcgctcgtatggactgatccctgacttaatcgcacccatcaggcctctgcagctttatgctgatgggggttaccagctgagaattaggcgtcttgagggtacccctaattatggtccccgacaataagtatcactgagattattaaattatatttttggattgagggagtagtatttaaagaagagccttgcatgcaatttcttttgtttgaataatgttttcaacttaaatacttttttttgcatgtgtaacatttattctccataatatttttccatgtatctaacttataaatcattttcataaaccaatgtcaaagatgaatccatgtttcttacttggaaaccccgaacaaacaccactagcacgaggcgctcgcgttagcgtcgctcaccgacgacgagaagaaacttggcgactgtcagttcgaactctggaagcagtcctacatggcccatgcgccgctgtgtacggcaagctccggcgcagctgccgcttggacgtggtccagagcggctgcaccgcgctgtccatcgtcaaacatggggacctcatggtcgtcgccaatgtcgacgactctcgggttgttctgggcatcgcaacctacgacgacgccatcacgccgtctagctcatcatccacctgaagcctaacctgccacgtaagtcgctactgaccgaccatgaattcttgtgcgctggaatgatgaccattgttgttgttgtgtgagtgtcctcgaacaagatgtatgtagaggagtagcacatccggtggtgcaacgaccaggtgtactacctcgctgatgagcccggggtgcacttcatttggcagcccagccaagagtgatcggtactcaccatatcgcgcgcgttcgacgactattatatcaaggattgtggcgtcatctcgacaccggaggtgagcagaggtggaccgacaacaatgaccactcgccatcgtcggggtaccttttgtgtcggcctgcctttaattctcttcgcaaacacacacttgtattttttgtttaagcaagcgtgtatggtggtgcgtgcctgatgactaacgatgtacgacggaacttctaccggcaggtgtggcacgtgctctccaataatgagaccatgcaaatcatgacatatatcgaagtgtgcatgatactgatagttgcaatgtagtagtgaaacaactaaattaaaataacaaaatttatgtatggctaggatcacaaatgaattatgaaatattttcttataacaatataagacacattttgtatataagttatcatggtattatatgttcccgttgcaacgcacgggtactgacctattgttcattaaggatctttaatagatgttttttgttattttctcgaacctaaatgttcgtcgaccaaacttgttttgtatcagtgtataatattattgtcactgttttttatgtcgcggactatgttttttgtacgtcattgaaactacctataaaattgtcactgtgtatcagcgtatgtgtatgcagttggcttgatgtgagacaataagctgaacccacggggttttcatggttttccacccaattacgagttggtttgcggtcaataatattattggatgggttgggtttattttttttcttatattttagggtgggtgtgggataaatatcaaagttattatacttgggtatgaatgggagtgagttggattttttgccattagcaggcctacatggcggcaaacacacccccatgtctttatccccatttcatacaagtcaggtaattaacgagtatccgctgacatgagactgttttgagttttgacgctttcataccggcctgatgatgataccttggcagttggcaaacggcccatcgatgtccgccattaactgccgatccaatccaagtaaccgtaggtatctttctgaccatagtccacaagtccaaaccagccgtcaaaccaaccgatcatggacatccgatgggcatgcttgttgcgcgatcaaaagtcatcatacaaaaaatgtgatgaataaaaactggacaaaatttgtgccatcgaatggagcatacagtcgtggggggcctgctacaagaccaggcgccaaccccctgcctctgggctctggttggtggcggtagccgggctctcatttaaactacccatctgcccccgattcttttaattacgggcgaccctcgcggctccgcccctattttaagaccccaccacggcaccacctcctccgcaaacaacacacgaacaccgcaccgcaacgtagccggctaggggaagagctctttccttcagctgtgccgtgcacaacgcacggcacgctggtttggtttgcatcgcccccgccaagacgctgccgtgagcaggcagagcgggtgggaagactggtgggcgagccggccgcgccgagggatagcagcagcagcagcaggcgggcgac

SEQ ID NO: 90 - DNA, 2719 bp, Setaria italica
aaagcaaagattcatgcctgagctgttggtgacgctatcagctttggctcacctaaaagcagcgccggccacagctggggttcgtttcgtctactctgattctcttctgaagtctgaagtccaaaccatggccaaagtgactgttgacgcaggcacgtaaatattcaattgtcacagtgcggtttggacaccacgtagacaaacgtttcctggtcctgagcttttgattggcccatttcagactagtacgttaatgcttgcactggcccgaagcggaccacattgctactgtgtgtttatctgctccgagaaattgggagatagggtggttagtacagatgagcagctgttcgctttctccatctatcattcttcagcacctgcacttccaaaaagctttgaatttggcttaggtcatggaacggcttttgtcaggatctcaacgttctcctttatttgcgagctcaactccttcctcatagctaactcttcgttcagtcctccagcattgccctctgaagtctgaaccactccatttctatattgtacaaggaaaaggagtgctatatcagggttgcatttccaaatctgcaaagcacgcgtacttgaagccatcaaaagatgactggccagcaggagcagcttgccagtgacacagatttcgtccaaacggagcacgcagcgcatcgtgctacagcgaatcgatcggatcgagctgaggccaagcattcaaggttttgcaggtgcattgtgatgccgacccgacacacgcgactgctgcagtggctccatctataaatctgtcctatataccagcacgcgtgaacagacaaaaaaaaacatcaacaacaagaagagaagttttactgctgcttccagaaaccagcctgatcatgagtttttggctttgagaacgagctgaggatggttttccagggcaggtgaacgacatctcgccatttctcaatcctctaacctctccagatgaggggaaacagttcagtgctttgcctgtgcattgtgcgagaatcgggcgggagcgttcatcttgatccagcacagcagggctttaattgtgcaagcagaaggtaccagtaccagcagaggattgatttgcacatgtggaagctctgaagccgttgctatcgcatcgttctgacccggtttggtggcacgagcaaggtagccaaatcaggccagccattgcatgtgttgccgtacatgcacaagaaagtttaaccgcagtcatatgaagtactactgacccggatgtactacatgactgcagactgtgatgcttgctagaggtaaaaggacacggagggcaggagtcctgccagttccctcaatgctctgtgctccgatctctctagaagggacccccttctttttatttttgaaactatagaaagacaaatttcccttccccttattagattgtactaagtactattttgattacttgtttttatgaattgtgcagaggctgagaggcctgatccaactttgggtgcggccacaatgtgtgggaaatatgcgctgtgttcatctgcacctctctgccccctttatctcaagcaaacgtctgtaccttgattatgtacttggtatgattggtgtgagattcagatgcaacgattacttcatatgagccttgctcatcaccgattttccctcccttctctcgtgcctttttccttttcccaaaccactgaagctcaaccagtccgcatcagttcactactcccgctagcatggcaacggcatgatcatgaaggattccaacaaatggcctggcagctgatggaattcgactgctctctctgaaatttagctactccttttttcatcaattgagttttgacgataacaatttggagtggcgcaattcacaaccacaaccaacacttgtctccctctccctggacggaacagtgcggccttgctaatgctaccaacaacacggtgcgcggtcgtacccttggccgttggcaaatggccgatcgacatcgccattaactgccggtccaagctgcgccaggcaagccgcgaaagccgtagagtaccttcccgttcctgcccaccaacggcttcctccgcgcaccgggacgacaacctgatcgacccatccccaccacttgatcgtcgcacaccgatcctcgcgtgcgctacagttcgtcacgcacccgtacgttcaaccgtcgtctcctcacccctcgctaaatcctcgctgttttcccgaaattgcttaccaaaaccccgtgcgcgcgcgtgcccgaagctgcagtgctgcaggcggatgcgagcgccggagcaccggagccggaggcaggcaggcccccgcccccagtggccaacccctaactcctccggttggtggcggtagccgggctctcatttaaactacccatctgccccggatttaattacgggcgccccctttcccggctcgcccactatattaagaccccaccacggcaccacgtctcctccgcaaacaaacaccccaactcgccaggccaacgtacccccacacaaaacaccgcgacgcagcgccccggttctccctagcttcccactgcgcccaacgcacggcacgcggttgcagcagcgtccgcgagttccctgcggagagcagaggccagaggcgagcggcagggagggagagtgatcgatcgactagtgaagtgagccgcgccgcgcgagggcggggggcgcc

SEQ ID NO: 91 - DNA, 2500 bp, Setaria italica
aaagcaaagattcatgcctgagctgttggtgacgctatcagctttggctcacctaaaagcagcgccggccacagctggggttcgtttcgtctactctgattctcttctgaagtctgaagtccaaaccatggccaaagtgactgttgacgcaggcacgtaaatattcaattgtcacagtgcggtttggacaccacgtagacaaacgtttcctggtcctgagcttttgattggcccatttcagactagtacgttaatgcttgcactggcccgaagcggaccacattgctactgtgtgtttatctgctccgagaaattgggagatagggtggttagtacagatgagcagctgttcgctttctccatctatcattcttcagcacctgcacttccaaaaagctttgaatttggcttaggtcatggaacggcttttgtcaggatctcaacgttctcctttatttgcgagctcaactccttcctcatagctaactcttcgttcagtcctccagcattgccctctgaagtctgaaccactccatttctatattgtacaaggaaaaggagtgctatatcagggttgcatttccaaatctgcaaagcacgcgtacttgaagccatcaaaagatgactggccagcaggagcagcttgccagtgacacagatttcgtccaaacggagcacgcagcgcatcgtgctacagcgaatcgatcggatcgagctgaggccaagcattcaaggttttgcaggtgcattgtgatgccgacccgacacacgcgactgctgcagtggctccatctataaatctgtcctatataccagcacgcgtgaacagacaaaaaaaaacatcaacaacaagaagagaagttttactgctgcttccagaaaccagcctgatcatgagtttttggctttgagaacgagctgaggatggttttccagggcaggtgaacgacatctcgccatttctcaatcctctaacctctccagatgaggggaaacagttcagtgctttgcctgtgcattgtgcgagaatcgggcgggagcgttcatcttgatccagcacagcagggctttaattgtgcaagcagaaggtaccagtaccagcagaggattgatttgcacatgtggaagctctgaagccgttgctatcgcatcgttctgacccggtttggtggcacgagcaaggtagccaaatcaggccagccattgcatgtgttgccgtacatgcacaagaaagtttaaccgcagtcatatgaagtactactgacccggatgtactacatgactgcagactgtgatgcttgctagaggtaaaaggacacggagggcaggagtcctgccagttccctcaatgctctgtgctccgatctctctagaagggacccccttctttttatttttgaaactatagaaagacaaatttcccttccccttattagattgtactaagtactattttgattacttgtttttatgaattgtgcagaggctgagaggcctgatccaactttgggtgcggccacaatgtgtgggaaatatgcgctgtgttcatctgcacctctctgccccctttatctcaagcaaacgtctgtaccttgattatgtacttggtatgattggtgtgagattcagatgcaacgattacttcatatgagccttgctcatcaccgattttccctcccttctctcgtgcctttttccttttcccaaaccactgaagctcaaccagtccgcatcagttcactactcccgctagcatggcaacggcatgatcatgaaggattccaacaaatggcctggcagctgatggaattcgactgctctctctgaaatttagctactccttttttcatcaattgagttttgacgataacaatttggagtggcgcaattcacaaccacaaccaacacttgtctccctctccctggacggaacagtgcggccttgctaatgctaccaacaacacggtgcgcggtcgtacccttggccgttggcaaatggccgatcgacatcgccattaactgccggtccaagctgcgccaggcaagccgcgaaagccgtagagtaccttcccgttcctgcccaccaacggcttcctccgcgcaccgggacgacaacctgatcgacccatccccaccacttgatcgtcgcacaccgatcctcgcgtgcgctacagttcgtcacgcacccgtacgttcaaccgtcgtctcctcacccctcgctaaatcctcgctgttttcccgaaattgcttaccaaaaccccgtgcgcgcgcgtgcccgaagctgcagtgctgcaggcggatgcgagcgccggagcaccggagccggaggcaggcaggcccccgcccccagtggccaacccctaactcctccggttggtggcggtagccgggctctcatttaaactacccatctgccccggatttaattacgggcgccccctttcccggctcgcccactatattaagaccccaccacggcaccacgtctcctccgcaaaca

SEQ ID NO: 92 - DNA, 2754 bp, Oryza sativa
ggcaggatgtactcacgtacagttagagcattaacttaggcaagcgtttttctttgcaggtaatggcctctgtcaaacctaatacagattggcagtttggcgcgatggacaggtcatgatcaattttaaataagcagatgatcacatttaatgtgtagtatgaagggaacaggtagaataatacttgtaagtttacaatcctgtcccacgaagatgtcgatcccctaagtgccgttcgtcgtagtacatgagggacaggtccaaaacgaagagacggaattcgctcgtgcgaaacaagggcaagagagacgtgaaccgaacaggattgcccttgcacacctgcggcggatgtatggttgcagctaagctttattaatgtgagtctctgcccttcctctggtcgatcgatgacgagcaaacacagcgcgtttcgccacgctttctcccaacccccaactccatcccatgtcggcccatcgtccattcgtcctccagaccgatcacatattcagacccgtcaacttcagcatttcacgcggccactacgacagctgcttcggctgcactttcactcgtatcagcgcgaggggaagaagaacaatccgtggttttccgtttcttcagaggcatggacagatcgtctcacgactcgtacgcgaagatgcttgatgcttcccggaggatcctgtctcgaattttgattggatcactgcgcactggacactcactactacgttaatgctgctgccagggctgcagccaaaggaccacactgtcattggctccgggacaataggaggccatatatttagccattttttagggagattttcaccaattgtacagttgcactattgctacgcagatcactgcatacgcaattaactctttcttacaagctcagaagctgtctgcacctatatagctactccctcctccgttctataaaaaaccaacctactatcggatgtgacacatcctaatactatgaatctggatatacatcatactaaaatatgttatatccggttctagattcgtttttatggaacggagggagtattctgtcatcagctatcactgctctgcctgaacttgtctgagctattactactgtagtatatgaatttatgaagtggagtctcgtaacaaaaatacgagtatactccgtactgtactacccttatcaggattcaaggatactaggagtatagcattaccagatcaggcacttagatgtggccatccaaagagtaatggtaatagcctaataggagtaccatctactattgatctttcaaaaaaaaaagtactagtatagaagtagtatccagctagagctgcttaacagggtcagaatttgtccaaacagagcttgtaatgcacactgacgaagtcgatccgatcgaatcagagtcaacatttaaagagtactatttcgaagtaaaactgttcagttcttacaagattacatgtgaatttgcaagacttggacatgagtgttcatctcgtagtttaatgatgggtacccaacctgcaacaacagtgctttaaattgtacaagcagagggtaccaacagagtaatttgcacatgcagtcctgaacctgatgccattgcgaaacacacaaccctatacggtgcagatgcaagggagcccaattcagtcccagccattatctgtattgccgtacttccgcagggaaagttaccctctcatctgatctaccattgcatacatctcaaaaggaagtgagtaaaaaagaaaacaggaccaatcttcagagataagtttttgaaacctatcttcagagataagttcactcggcgataggagaggacctgatttggactcaaatcaggtgttgacgaatagagtagcaagagttttttcgacgggtcaagacctcaagggtcttaacagttgaactaactcggttatgatttggacacttggtgattaactactgataatagtactacttattgttattggcttgttacatcattcggtgctcaaaaatcagatgcaaatttagatgggacagacagcagctactagcaacataagagaattatgttcagtgtatcatgcatgactaaactctgaacgtactcacctggatccagatgcgagcagtacagtacctgtgcacattgcttgtgtattactccacttaattacgaactctattattttcctccgataatgcccgcagaacaaggttgtcactgaaaaatggtcctctccagagtccaggagctataggaggagtatgatactccttagcaatcatatactcatatgacatatccaaattgacaccggggttaagccgttaaccgtcactacgagttgcacttgtataaacaaaaaacaagggagaaaaccttgtgtcccccccatgatgcagaaatctaataagagcagcccaacgcttccggttggtggcggtagaccggcctctttaaactaccccatccgccccagatttatcaattactcctcgtcatctcgtctcgtctccgccaccgtgcgcgcgtcccctatattagaccccccaaccgggcaccggacacaccatcaccaacacaccactgcaaacccatccgcctccgcaccgcatcgcacctacaaattgtgcacgctgcaccgctcaaaaaaaagaagaaactaaagtcgtacgtaggacgcggcgtgcgagcgttggtgcggtgcgcggcggcgcgcggggaagtagtgagagcatcgatc

SEQ ID NO: 93 - DNA, 2500 bp, Oryza sativa
ggcaggatgtactcacgtacagttagagcattaacttaggcaagcgtttttctttgcaggtaatggcctctgtcaaacctaatacagattggcagtttggcgcgatggacaggtcatgatcaattttaaataagcagatgatcacatttaatgtgtagtatgaagggaacaggtagaataatacttgtaagtttacaatcctgtcccacgaagatgtcgatcccctaagtgccgttcgtcgtagtacatgagggacaggtccaaaacgaagagacggaattcgctcgtgcgaaacaagggcaagagagacgtgaaccgaacaggattgcccttgcacacctgcggcggatgtatggttgcagctaagctttattaatgtgagtctctgcccttcctctggtcgatcgatgacgagcaaacacagcgcgtttcgccacgctttctcccaacccccaactccatcccatgtcggcccatcgtccattcgtcctccagaccgatcacatattcagacccgtcaacttcagcatttcacgcggccactacgacagctgcttcggctgcactttcactcgtatcagcgcgaggggaagaagaacaatccgtggttttccgtttcttcagaggcatggacagatcgtctcacgactcgtacgcgaagatgcttgatgcttcccggaggatcctgtctcgaattttgattggatcactgcgcactggacactcactactacgttaatgctgctgccagggctgcagccaaaggaccacactgtcattggctccgggacaataggaggccatatatttagccattttttagggagattttcaccaattgtacagttgcactattgctacgcagatcactgcatacgcaattaactctttcttacaagctcagaagctgtctgcacctatatagctactccctcctccgttctataaaaaaccaacctactatcggatgtgacacatcctaatactatgaatctggatatacatcatactaaaatatgttatatccggttctagattcgtttttatggaacggagggagtattctgtcatcagctatcactgctctgcctgaacttgtctgagctattactactgtagtatatgaatttatgaagtggagtctcgtaacaaaaatacgagtatactccgtactgtactacccttatcaggattcaaggatactaggagtatagcattaccagatcaggcacttagatgtggccatccaaagagtaatggtaatagcctaataggagtaccatctactattgatctttcaaaaaaaaaagtactagtatagaagtagtatccagctagagctgcttaacagggtcagaatttgtccaaacagagcttgtaatgcacactgacgaagtcgatccgatcgaatcagagtcaacatttaaagagtactatttcgaagtaaaactgttcagttcttacaagattacatgtgaatttgcaagacttggacatgagtgttcatctcgtagtttaatgatgggtacccaacctgcaacaacagtgctttaaattgtacaagcagagggtaccaacagagtaatttgcacatgcagtcctgaacctgatgccattgcgaaacacacaaccctatacggtgcagatgcaagggagcccaattcagtcccagccattatctgtattgccgtacttccgcagggaaagttaccctctcatctgatctaccattgcatacatctcaaaaggaagtgagtaaaaaagaaaacaggaccaatcttcagagataagtttttgaaacctatcttcagagataagttcactcggcgataggagaggacctgatttggactcaaatcaggtgttgacgaatagagtagcaagagttttttcgacgggtcaagacctcaagggtcttaacagttgaactaactcggttatgatttggacacttggtgattaactactgataatagtactacttattgttattggcttgttacatcattcggtgctcaaaaatcagatgcaaatttagatgggacagacagcagctactagcaacataagagaattatgttcagtgtatcatgcatgactaaactctgaacgtactcacctggatccagatgcgagcagtacagtacctgtgcacattgcttgtgtattactccacttaattacgaactctattattttcctccgataatgcccgcagaacaaggttgtcactgaaaaatggtcctctccagagtccaggagctataggaggagtatgatactccttagcaatcatatactcatatgacatatccaaattgacaccggggttaagccgttaaccgtcactacgagttgcacttgtataaacaaaaaacaagggagaaaaccttgtgtcccccccatgatgcagaaatctaataagagcagcccaacgcttccggttggtggcggtagaccggcctctttaaactaccccatccgccccagatttatcaat

SEQ ID NO: 94 - DNA, 2000 bp, Glycine max
tttaaatttgttgcagaatgatcataattaaatttccaaggcaataaaaatccctgtctacaaatttatttccataggggctttggatcgatggcgtggaccccacctgaaagtgacacccttggatctcacgggtttcagtgtcaaacctcatttaataagtcaccccatctcccacccttaatttccaccatccaattctccaatctccttcttcataaattaacggctgtgatctatttgaccctactactactttatgaccattctccattcggttacaaatcaatatttctctcactcccaaattaaaaaattgccaattaccaaacatgccatctctcaaaaagtacaaagtgttactattatttctatttaattagtatagtagtactctttctaataaatttaatattaaaatcacataattgtacgtactacttagtaattgagattcttcaaaataaagagaataactctcaggtaatttagtgaattctgaaagacaataaattgtgtttttgacaaatgttaatacaacaattttatacagtagtaatattttttatatcacaaaaactaaatataatttcatctgaataatctatttattttttaatgtaaatatttatcacttagattatcaagattacgatttttaaagaaaagattaacaagattacgaattgggttaagccaatttgtataagaaaattggatatcatatgcccatgaggtcttgggtcctgtccacaaggaaatttaactcatttttactctatatatacttctaacgtcatatattgcaacaataatatatgcgttactttgacgaaatttctactaacgttggcattgaagttgcttttagaagtacctatcaattttccacgatatttcagtcacattgaaacaacagttgaattcagaaaaaaaaaattaaaaaaattgaacttcaaatacttcacagtccaccttaaacatatcattcacattcatctaagataaaaatcaatcactaattttaattagataatagtattaatagaaacattaaaagccttatctttttataaagctgtttttcattttcatcacatccagcatcgatctcaatccaaactctttcttttcacaccctatgagtaactcaaacctgacatcatccaacacggcgcgtgtatcccactctcttccttggaagacgtaaggaggcaggaagcgcgtgggagaggaactgagaggaaaaaaaggtttgactttggtgaagggtgtgggaaacgtttagaatggccattaagaaagcaccacgtggagcgtaacagccgacgtagtaagtattgctgatcggtttctgtcaacccgcatttaccatttacagtaaatttattaaattaaattaaattaacccatttattacaacacactatgaattgaatgaatgaatatgagcattatatgaagagagagaggaacgtagaaaagaaaactaggataaggtaaaggactaaggagaaaaagaaagagaaagagagaaagggactctgtccccttttgtgtgcgtgtgttttgtcaactgagtgaactctcaagtgaactaacatcaccaaaaaaaccactctcttgcaacctcctcatcacattgctccttctggtattccatataacttattaactttgatttttttctctctttaattttttcttttcttccgatcatgtaacatgctaaaaaataatttgtaagattctggttggttggttttgtagggaatctttttctcttgtttttttctgggttgaatgagaataatgttttgatagtttaaagctttttatttgtttggtttctgatatgggaaagttttgttgtggggtgttagagacaggtttggctcaactgaagtaaggtttggttatcttattaccttatctctcaccacatttaaaaacacacaaaacacagttacacaagtgaagtgtggttttgggaagcaaga

SEQ ID NO: 95 - DNA, 2000 bp, Glycine max
atgaattattatatatgctctatttgttaaattttttaaaataattattttaaaagttatacatagatttttttattggttaatagtataaaattttaactctcacaaaacaccatgcacgaaaattaaactcatgaacaatataaatatacttttttatctgaaataaacgagggaaaatatctcttatttgagaaaaaaaatttaaaaatatttttgttactactatgtcataagttaatatcttggaagtttaaagaatattaacttgttaaaataattcaatattttttttgtctgtaatgtgttagccagtattaacacaattaatttgtttttggtaataacaatgcttagatatggcaagaaaactcatacttgtgggtatccgtctgaattcgtttcgactttgacgggtaatacctgagttgacctggtataggttcgggtttggatttttctcgataatcaaaagtcagatacgggtatgggtatgaggttactagactcgtcccgaccccaaacccgaactcgccctgccacttaaaatctttaaatttttttgcataatttaatcaaaaggcataaaatttttattactagttaattttattttagaatttttacataatttaatattattttcttaactatttttgtagacacatgcgctataataaatttattaatatataagtagttaaaacaaatgtttaacaattaactttctttttctaaaatcaaacttttaatattttttttataaaaaaaaatatttttttaatttaaatcgtgtatgggacagggtcggggataccggataggtacaggaatgagaaaataaatttaaacccgatatcgaatacgaatatgaagatatattgagaagttagaataagagattgagagacaatactcataaccatcccactctccattgcaatgtctaacaatgcttacacatgcacaagcaatgactcagctcaggtaacattcatacattctattaacatgttggcgtcacaagcattattataatacacccaatttttcctattaaatgaaaaagacgacgtaccgtatgcccctccaattaaacacaaccgacatggagaaaatgatgatggttgattgcctacgaaaggtgacaattcgtgaaaacaatgatgatatatgcttgctaaaagagaaataccaataaaatgtttacacattatttattattaactgaacattatataaattgtaaagagtttaataaatatatattgttaagttgaaagtttttgcagcattgttgcttgcacttcttgtgcaacaattctgaccttatttatacattatcaatcaattgaaaatatacagtttattatagatgatgattttaaaatttaacaaatttattataaataatgatttattagacaatggtgtaaaaaacttttatattttactaaaaacatgtttttttaaaatgtatgatgctattattcacgtttctcattttttaacagtcggttgaagacttttagtttagctgcttcacactaccaaggccattccttccccactttgaacaattcacatttttattattttttgcagtacccatatttttcaagtgacagcctactaatcattcaaaggtgtaaaaaattgaatttttattgctatccagcaaccacttttttgtttttttttttgtacaaaatatatagataccatatgtgacatgcctataataaattaataactgaaggctgataaaataaaaggttaataactgaaggtagttttatctacttgtctctacgtcaagaagcacgtgaacacaactgaaaggtgccaacaaaacatgttggaaggttagctacataatcttcggtggagcaaatattccacttgtgcacatgcatgcatatataattggttatttgcaatgcctcattccatgcactgaaactagttgcgacacttgtattgcagtgcacataataacc

SEQ ID NO: 96 - DNA, 2000 bp, Glycine max
acttcgatgttcttgcacttgttatagaattcatgtcataataagtgtgtgctcgaagtaaaaattaattttaattgttttttctatttatacttctaacattagcaatttgcataacaaacaagatttaatacaagattaattttgtaaaattgttactttttttatttattcttgctagaaaaagagaaagaacctttcacgaaaatcttcataatttcatttgaggttcacatatatctttggaagtggaggactacgatgcaacagtttatttattatttcagagaataaccattacccaaaatttctttgaccggagtagcttgtccatgaaataagacatggtggtaataaaaaaaaggattaattgaacattattgtcatggaatagtaaacatacataaattaaatgactcttcatgtctttttttcttcttcatcatgatattcataggaaataatcctcatttgactaattagttgggtcaccaggtgtaccaatagttattggtctttttctttttgagtaacaaataccattgaaaagtcatttaatttattatttgtatgtataatggtagatgatctggaggttattattatatctttttcgggtttgtgttaagtttatttatttttcttaataaatgattcattacaaaaggatttttttaagtgtatatttcttcttttttttctacttcttctttcaagggcaggaaaatctcatatattgtggtccttccttcaccactcccatgtggatggttcacgggttcataattactcacgcttacttagccaacatttagatatgactctatctaaatttttttgtttacttcaacatttctcacttgtcctacttttgttatcgaataatttttggatattaaatggaccttcccagaagttaattttaatgtggccaatttcttctcttttgtaattagctcttagacaataataataatgatatttctagattatctccatttattttcctattcatacgtgattctgttgtgcgattgaatgttagatagacggtgtagatgaggtgcaaaattttaattcagtctgacatgtttaattgtgaagaaaatgttgaaaaaaattaaaataaaagaaaagaaataaatgagaagagaatgcaaagtcttgaattaaataaaaaaatattaatagcaaaataattttaattaacaccacatgactatatcatacaataaatataaggaaaaaataaataagaaaaataattatttagcctgggttgaagcactagttgattttgaccgtgtgtagcaaaatgatccctctcctaagatacgacaaccagttggtttcgaccgacgtgtgcagcaaaagaatcccgaaacttgtgaacactaatgcttttgctctaaaaaataagtttttataggaaaagaaaaagaagatatttgggagaaaggagttatgtgcttgtgttgttcttttttagagaacaagaaatatatatatatatagagagagagagagagatagatcaccttgtgcagcaaacaaaaatatgatcattgtattcaacctatagttattaaaacaaacgtaatagaccagttgactcattaaaataaaatcttaagaaaatttaaaataaatattttattttataaaataaaattaatatatatttataaattttaaattaaaacacagatacttatcgatagaaaatagtaatagtgtgtaggatattaatgaaaggtgaaaggcttttttgttcacccccaagacttgttgatgttgagtcgttggtaacaatacacaccacctaacaccatcacgtgctcaccttcaatttacaatactcgaacgaaacgatttgttagattaagtaactgaaagattaatgttattatttaagaagcttctctcctgagggaggattaaaaaactgtctataaagtaagtttcattttatcctttgaagtgtgtgagagagtgaaaac

SEQ ID NO: 97 - DNA, 2000 bp, Glycine max
acatagccccaaaaccactattgaatatcaattagaaattggaagggttacttaaccttccattaaacatacaagtttccccatgataatagggatcaaaaataatgatcagggattcattccaaagaaaagtttacaaaatcaattttcgctcattttataggagttaaacccatttttaagccaaaaacctttacgtataaacaacattttaaaagttatttttcaataaaagcatcttttagagtttactgtttttatggcatattcaccccagtacagtttatattgctttcgtttaaacaggagttcatgaatttctaaaaaaaatgtttatgatacttgtcatttcgattgttcatatggtgcctgtcagataattaatgtctccgtggtgtttaactgttaagtagttgattttttgtcatgtaatcttgtaaatgacaattctatcgttaatcaaacaatccgtatacacacacacacacggagaaactagtgtgggtttgaccaaggaccctgaattcttcttctttgtataaggtcaggcaagtggtagagttcgaatagtaagttttgaagtttaaagcttgtacacaaaatatatatatatatatattgataaagaatggatataattgttttacaacgtgcagcgagggaacccttcaatacgcacctctctaccaagtctaacttaaaaacacagaattatcaaacacccaatttatgtgttagaatgtcttgcttttcgctactactattgtctggtgggcatgatgattttctcacaaaataattggaatattccacttatctctggctgatcttttttcttacatttaagacaatagagagtattaaatttgttataatcgtaatatttatatattaaatagtatttatggtatatttaaatatatatatatatagaatattattttatatatgcatattatagttattgttaattcagcatgtgttctggtttctgaaataaaataaaaaaacaaaaatttgaaaaatagaaactagaataaaaaaaatcaataaaaaggacctcacttattattttgactgttactaattacggaaataagttacttaaatgtattaaattaatttttgaaaattaatgcattaaagaaacttatttaatgtattaaataagtatttaatgcatttcaggaaaaagcatttaatgtattaaatacagtttagaaattaatttttgtttcattttttatttataaaattatgttttctttttacatatttgtaaaattatttggagagatgaaaaaaaatgtgtaaaaagaaagagtctaccaacaagtagttagtccaaatagtattgaattcaaattttttaaataaagttttgttaaaattaattatgaataaaattgatagataattctaacataattacacaaaaaaatctttaatcataatactccctttagacctcaaatgtaaaaaaaataaaaaaaaaatcaattgtgttagattaaaatataaacaaattttaattaactatcacctactttatcacctacttaatgatgtattttcaaaacatcattcgtttaattgagttttatttttaataatcttatttttttttcttatataatcaatatagatgatattttaaggaataaattaactttttattgaaattatcaaaattaaataatattaactaattttttgtctaatggttgagtccagagagagtaatatttgtgggtggagttttactggtggatgtggacaggtgtgagccacatgttaccatgcagtgagtcagaaaaaagaagtggcaggatatccggcgggttcacggcttggaagttgcaataaatattaaatgaggatgcagatattcttcttctgtcggtggtatgatatatatatatatataaggccgggcagaaaggaaaggaaatactattacatagcagaagcaaagaaaatactattactagctaatgagt

SEQ ID NO: 98 - DNA, 3138 bp, Sorghum bicolor
tgccacgacgacggagtacataccgtagactgccagtagtacatttactttaaccatcagtaaaatgtagcctggttgttgagaaactgtagtacatgaaagttggacttcagccgtagcttcgcatatataaacactgtttcaccgggagatcgatgtaggagtacgaaccaagtacgtacgagtatgcagttgataatgaactaatgcaccccatgataatcacgccacattgatctaaattaggatgaacatgttgatgtttcctcttaacctggttaattagacggcgaacgagtaagattttatttggagtcctatgtactccctgattccatttggagaaatgaggccaaggttttgctatcaacatcgaggtaagttagaaaacatgcaaaattaacttataaagaacaaaataaaagaaaagaaaggcagaattatgaccatatttacccgtttgagccacacctgttaccacttaatgaaaaacgcgctgttgcgtggtctcaaaaaaaaattggagttgtttagacaatactttctctatgctaaattataagacgctataattttttaaatgtatagttttgcaatgtacttagatagataagcaataatgtaactagtagagaagatatataaatatcttacaatttcaaaccgacaaatatattcctgaacgctggctgtagttagcagtcgcaaccaataatccagagacaacggtgcatgtgtgtgtcaatattgcagcaaccggatgtctggaacacgtcacgatgcctcaacgaaccagatcaagatggatcacgacgcgtgccaaactcctttacgcctagctggaccctttagcagaaatgggatgaacggttgcaacaacgttggatgagcagtgtacttcaggagccaattaaggagaaaatcattaattttgccggcgagcactatgtatgtgcgccccccccccccaccccccacacacacacacacatcctttacgagtaggactactacaggtatggttaatttgtacgtttcagtaaccgatttttgcgggtccagttggagacagaacgatcgaggaaggttttgccttttgggacagctcacaggtggctccgcggtgacctaggaaatgaattcacttagagcaagtacttcctccatctcaaattgtaagtcattccaacaatcttggagagtcaaacttttctaagtttgaccaaatttatattataaaataattattattatagtactaactaagtatcattagattctttgttaattatatttttatagtatactcactttacgttataaattttagtatttttctctataattttggtcaaacgtgaaaatgttttgactctctaaaattcttggaatgacttacaatttggaatggagggagtacaataaaatcacgttacttgacttagacatatcagcaaaattctagtggaaaaaagagaggagggagaaaagctgcttagcttggcgcaacatgtaacgtcgagtgcccaagtggtgtgtgtctcgctactgtcctttcaactacctcgcgggacacaacagctgagtgagcttaggttaagctaccatgttgtcattgctgttcacgtcatcctcgccgtcctccagcctcacgcggcgcctgctgtcatggtcgcgtccgcgtgtgctcgcctccgctgctcaccagtactgtgagctcaccatgggttcgcccatgcgcgctaataggatgggttgttcgtcgacgcgaacaaaagtgtggtgatgacgaagagaaaaggatagtcattggtggcccacataataaaaaaaaacacattgagaacagtaaaaatcatattattattatatgacttgtttttatgttagtctatcagtgatatggcttgacttaggtcactcacaatgcaagactctatcacagagtctaagacaattaattatacattatttatggtattttgctgatgtggcagcatatttattgaagaaagaggtagaaaaaataagactccaaatcttatttagactctaagtccacattgttcgaggtaataaatgactttagactctatgatagagtctgcattgtgaaggcactcacaatgtaagactctatcacagagttcaagacacttaattatatattatttatggtattttgctgatgtggcagcatatttattgaaaaaaaaggtagaaaaaataagactccaagtcttatttagactctaagtccacattgttcgaggtaataaataactttagactctatgataaagtctgcattgagtggcccgagtgctcttatagctaaatttactaggcttgttcttaggactttcgaaattactgccccgcgcacacgtcaccatgcttgaaaagttgaattaaaagtactcaccgtgttattatttactcaactattaattggaaaaaggcacgctggagctcagcgctagcagctgactgccataagaccatgtttggcaggttccgtaccggcctgagactctgtttagttttcaatttaaacttctcatctcattatatatacccaatgtttggacacatacctggagcattagatatagaatgtgttatagtacctaaaaacaaatgtgttatagtacctaaaaacatttttttcctttttgtaaactaaacaaggtttaagaatcatataagaaactcgactaaaatgattggaatctggaaataaaaactgatccatcgtttctgtttttttttttaaactctggaagcaagaatcaactgaatcctactgtagcttctagtttcccaagaaacgtttcttgattattatactaagtagggacataaacaactgaaaccctgggttagtgggaaaagggagccacagcacctgtccctttattagtagtaattaatataagcaactgtgccatttttgcatctggtcctatataaatagagacgtggaggcgtccaagacgcattcgaggcgacagacatcgtcgtcccagcaaagcacaggctctctccccggtcacccctctcgctcacgagtcacgagcatcccacctcagctagctagctccagcagctctctatcttcccgaccagggcttggac

SEQ ID NO: 99 - DNA, 3191 bp, Oryza sativa
gaacctactgccgtgttgtgctgtggtgctgcatgcctgctggcgatgagtgctgctgactgcttgctccatgctggatgccgctggtctgctgcggcgctgcgcgcttcctgcctgcccgcggctgccgccgtcacacgttcgtgcctcactgccttagttgtcgtcgctgactcattcactcgcgcgatcgaaaattgggaatgacaattgcgatggaaacgaaaggacgcggtgcttgttgcagcgaaaaaacgaagcaaaacagttgccaacttgccattgatatttttctagaagtaacgcataggggtgatgggccttgggctagatttctatggtggtccatggaccacagtgtaactccgctcctgtgcttaactcttattcttatttttaaagaaaatccgctttacaactttaatttagatggatgaacgagaacggataatgcgcccgataaattagggatatcttcttttgtggttttcttttttttttgccggttcggcggaagaaacaccgaccaaattttattaagattgaaagaagttacatgcatccgacattagaccgtcgagttaaggcgagaagacctaagaagcaaaacaaaagaaaaactgagagaagaatgtaaagggcaagtgcacttagggctactcctcactaaaccttcttttgtggattgatgcatcaaaaaactatatgtactaggttacatcgtgttttttttttcgttttcgtctcattctctgcttcggcctgccgtctgcttataccgttaattcgatgatgactccagacttcattcatgaatatatttctactatagatatacaaccctcgctcctctatgtttatcttcatcttcatcttcaggagattcaaacaccacctcttaaagatgaagatgaagatgaagataaaaattaagtgtttcacgtaaaacgatgtattaataacatgtgattaatagagttttaattgttataaacttgaaaaatgaattagtatgatattttagagcaactttcatatataaagttttcgcacgagacgtaccgtttagcagtttgaaaagcatgtcacgagtatccaaaatttaatcttgtgcttgcagaagaaacgaagagggcctaacccatataacctgcgtcattaatctatagcttagcaaagtttacttttttgcctgcctcctggcacaggaacgccgacgaagaaaaacctacaggctttctcaactatgattccttcctcaacctgtgaactctggcgacaggaggacgacaggggtgtatgtggagcagataatgcacagtaataatccaatccttaggacttacaaactgctggaatgaactgaccaagtacgtttagaacgtaggaattttgacttatacatgcatagtgtgatttgtacgtgaaatacattaattaattttctgaatttgtttccaatttctcgtcgtcaggcaatgccgcaatgccttgtcttaaagattgcaaattgaatgcgccatctccatcgatctctctatctccattgatggctgcccaaaaaataaaaaataaaaagagccgacaatgtttaaggagagaagcatacgcgcacgtttcgtgatgaaacatacatgcaagactaatttcgaattatatatcacatattcgctctctgaatgagcgtatcgggtatttggaatttcgtttgatatgtaaaagttgaattttaggttacttttttgtggaataatatatcataaattaatattttttataactatttatgtgacatgtaaatgacgagctgatatcagtttaggataatttcctcgctaggtgattgaacgaaccctgcacgcggcagacgtcgtggctactactatctagctagctagcgttggttacgcgtggctactatccagccagaattggttacgccgtcgcccatcgatccgccacaccacgccaaacgcgaacttaattgctactatccgatagtatgtacgcgtactacacaaaagtggggaaaagaaggttgtcctgactccatgagaagacgatccaaaacacggggccggacaaccaaacaagctagctagcggccggcggcgagccaccgtcgtcgttgctgaagacgtcgactaatttggcctcccggccggcgccatcgatcatctcaaaattaatactccctctgtataagggattttgagtttttgtttgcactgtttgatcactcgttttattaaaaaaatttgtgacaatataaaaaacgagaagttgtgcttaaaatacttcggataataaagtaagtaaaaaataaataataattctaaaaaaaatttaataaaataagtgtgcaaacaatacaagcaaaaactcaaaatcacttataatcatgggacggagggagtatatagtatccaaaaatcatctcaaaattaaaaccgaatcgaaactcgccgggccgcggcccgcccggccgtcctggcccaattaattccggcgaccgctgcatgcaacgctccgtacgtgatcgcccagcggctcgcgcgcgcaccacgcgtccacgcgtctctctcctttatacatggacaatggattaatttacttgtagaaaaaaaaacacgaggctagcttagcttgtgcccggcccagccgcgtgcgtgatttccccaagttcacaacctgtacgtgtgtgtggtacgtagcggtcgcaatcccgtttcaaatctcgatcgtgtgtggtgccattaactccgtctggttggggaagccggtggcggatagcccgactgacaggtgctgtggcctggcggccggccggccaatcgatggatggacggatggatcccatcgatgatccttcgttgattcgcgtcaacctctcgctgcccgaatcggactctcaccttccccgccctccaccgctgtgaccgcgcgctgtctgtcccttggctaataccagtcgcagtgcaactgtgcaagtgtttcacgtatataaaagcatcccgagacgcagcgcgcatgaccagccgcgttgggtgcaaaaccacaaccgccaacatcttctaactcccctcacggctctccctctccccgcacgcacaacaccggtgaacccctacgtactactgagctgagctgagaggacgaagaagaagatcaagctcgaggggcttgcgatc

SEQ ID NO: 100 - DNA, 3380 bp, Arabidopsis thaliana
aaaagatcaactattttcaaaacccattttagactccaatacacatgatcacggtgtgacgaaagagagatagctctatatataaactcagacaacgattgataggcactgatggctcaacgaatatactttaaaattgcaatacaataggattgtgaagaatatctcaacctgcaacattatggtgaaaactttaaaaaacaagcaccgatattatataaagaaattgcatgcattagtcatacgttatatgtatatatattgtgtgaaaactcataccttatactatttgatatagaatatgaatgtcataaaccacaagcatttgttaagtataattttttgtatacttattatcttatctttctgattatttatagattttaagaaattaaatctttttttttggtatctgtgtgttactttttataaatgtattttgaaaagtattatttcaatttatagataaatataattatgactctcaagtggatttttttttcacggtcaattggagtttggctgtgaatcttgtgaataatatcaactaattaagagtcggccgatactccgtatctttgatcactttcacccatatcttgaaatttaccaaatgttttctttcattggggtttctataccttttttttttggttctttctgtaatttgggttttaaagaaaaaacctataattacaaaaaaggttaaaagttaaaactaagcacgttcaaatatgttctttcgagatcccaccttcctgtctatcttataagaagtcgaacacgtgtgctcgttgtgtgaattagagtggttatttcaacatatataattaaactatgtatgtatcataaatacactgaatatgttggagttgggtcttgtggtaggctaacttgttcgcttcactttggtttagtttagccttgtaatcggtggtttcatatactgaaatttttaattttctaatataatccagatgacaaaaaaaaatcataaatacactgcaatggccatttttaaaaaaactttaaacgaaatatatatacatcaccaagtatcaagtaagtaatttggttgttttgatttttcaaaaaaacatttaggtgattcttttaacaaccaatcatatatgtagcaaagattaattatgtcaatcttttaacgtcacttatatagtttagctgtagtattattgtaagccaattgtacggacttcgtaaccgtttcgacaaagatacaaactaatcaatgtttaagatggcataatattccgacttcccctgccactcggtagtactgctgcgccatcctacaagaagcactcgtaaatgagtggttagacggccaaaaattagcaggattcaatccttgattaagagatggttcagataagccctctaggcctctactcgtcacaattcatatattaattgatcacactgcatgaaatgataagatcaagtcaattacctcaaaattaattgaaagataaaatgataaagcaacaagtaatgatcatatatggatgtaacaaccttcttcatccatacgaatatgataattcttttgtcgatcatttgccacatctatttaactaagtattttgtacattaagatcattttgcgagtattcccgcgttcccaacaaaaacgaattgaaaaactacatagggtgaattttgctctcgtggcattaaagagagaggctgacattatagattatgatatatttattatttttcttagtagatttcttgaccagcctttagatatgcttgctctgtcatggcataaagccttaaaccctaaagccctttacatttgtacagtaccaacaattgtacccaatgttaaatgaatgcggattaatttgtgatatgagaccatcaaaataaaatacttataagatagtagatatatagaaccgtaacaaaaagatgagaagaaaaagacaaattgaatagaaactggaccaaaagataaaagagtatatgaagaagcaagccaccaagaagtgtaaccatcgttgcttcaactgtaaaccgcacattaaatgtgtgtgagagaaagagagatagactccagctgtgagagctacgtccattgcatcaattgggttatatgtcgttaacaattttttaaaaatacataaataaatcaataaaatatttagaaaaaatcaatattataatgatattttgaagaagttaggtccataatggaaatatagagacttagtgtctatttatcaagaaatagtgtctatttatcaagaaataatgtctatttggtccacaattatcatattttttgtggccactcaaactacgaaaataatgaatattgttaatttttgtcttatttaagtctataactaacttactaattcggttgaaattgctaatatgcattttccttggtccactattacagtgctactgctgtcttattcttgaacacaaaataaaaaagatttcaaacacaaaatatgcatttttttgttccaccattacaaacctttatttggagaagtatacagttggatattaaatattttaattaaaaaattgaaaatattgaagttctttttctccagtattttggctggagcaaaactaaataaattccaaattaaaagctcgaacggaaaacatttactatgcaccaaaataaatgttgatatgaaatttgcatcagcatatacagtatgtatgtagtacaattgaacagagtcaaaattaattgtcactgaaacagtcagattttatttctgttaaaaaatattttcagacaaaaaatgattttttaacgtttttttatataattttattaaacctcaaaacattcctcagcagattgttttataatgttattattattttttcttaaataattttatttgaatttcgttatagagagataaataaaagatttttggggtctagttggctctcatagtttgaatgcttatataaggaaacagagctcgaggctctcaataatgccacataaaacacaacaccaaagcctttataactctttctggggtttttaattctctcaacgaacaaaaaaaaaaactcaactaatattctccatcctctttcttcagatttaagagaaaccttatcgttatattctctcttctcttttctttttgactcccacaagaagaaagcaaatttctttttctcaggattgcttgaaaactgtagaaatctttaaggtttttttacaccaataagagtcagagagagagagagagagagaaagagagatctattcataaaaaagacaggtaatctcaactccgaggagataactgatataacaatttgagagaataagaagaagaagaagaagaagaccaagctaaaga

SEQ ID NO: 101 - DNA, 3292 bp, Glycine max
cttttaatgaatcttaaagagcaattgcggaagttaattgaatctaatataatgtcttgaatttataatatatcataactaatagtatttgattttaagatttcaaaagcctctcaatttgaattgcttcgtagttggtattgaaataataaattcgtcactttttataaaataaaaaactttaaaagtgtcttgatattacaaatgtaaatatttcatgtatttacaatcggtagtacacattttaataacttttttcacaataatattttttttctgaaaaaattcaaaacctaaacaaaaacataagccaaataaagaaactcatctgaaagagaaacacaatcatatagaaaattatacatcttaatatgtaaatgaagagtttagaataaaagaaatagccgaatgtgtgttgaaagtaacaataagagaaggccccaccgagagaagacttgaacaaaatcaatttaaaatgagcaatacaaaagatttgcaatttaaaaaaaatctcaaaagaataaattttcgactaccagtaattggattttaaataggaagagattaaaaaaccacctcttaatcttatattccatcttccattccataagattgtgggtgtcattaaaacttattatcaatacaaaatgaaaaataaagagtcacggtttgttgaggagaagaatgcacttagttccaaatcccaatacatgtattaagtagtttcgttaacttttttttattaaattttaattatgttcaattaattatcaatttctataattaatttattattttaccccgaatttgagggggaaaaagttaaacttataagatactttccatgttttttaaaaattgcattcaatatttttcttttttttttcaccctaaaaaaatattttaattagttaactcacattacactcagatccccttaacagaaggtccatgttgatcacattatttttaataaaaaattatgtctaaaataccctcaaataaattacacttgcacttccatgtgtttttttaaaattacatctaatattcctccttttttgtacactataaaaaatctcttaattatttagctcccattacattcactaagacttcttccctctcctaaacacagtttaataatttaatagaaagtagacacaatttgatcatatgacttttaatgaaaatttatatctaaaatattcttatcttcttcctcttaacttcataaaaaacataacattattttgaacctgaaaatattttaatacttttttttctctaattgaacctgaactcaccttgttggtacgtatgtgttaatatctttccttttttttttttacttcaattttttttgtgtgttgagttgtttggttgcaacatttttgttggacatgttcccaacaatgccaattgattgaatatgatcatttgcttcaaattttaatgttttgttcatgcatttgtgttttaactcctttctttgaaatatttatttttgatgactagttgcttgatataatgtctcaatcaagagtttatatcttcttcgagtaatagcaacaacgaagtaaaaataaaatattaaaggaaaattgttattgtcttaagaaaaattcattaacagagtcaattgttaatttgttattgagtatttaacaaagatgttaggacaatttcatctgctcatatattccaattgatgttaattaacgacgttaacggaaagagataaaaataatgtaaaaaaaggaaggtatatcagatgcaatttgagaaaaacacaagaaatacgattataacaaaaatgttaaaacaattttatctgttcacatatttcaattaacgtaacaacgttaataaaaaagggataaaagtaatataaaaaagagaagtatcaagtgtaatttgaaaaataaaaaaacacaagaaatacgagtagtgtaattttttttagattaaattaaataataaagtctttgttaaattaaacataaggttactttataatgctctcataatgaaaaccggatttagaggtaactccaaacctaccttatctaacagctgagaggtactgtttcacctgccaaccatataaggcatttactactactctccagatctcttactgctggattacaacacgctacagcaacacgacgcgcggggtgtgtgttttcgtttacgtagattttaattttttaaggctctaattataattaattacagcgtaattaatatggagtactataaagtataataattataataagccatgtatataaaaaggagaagtgtatctgttaatgtgtactaatatcttacacaaaagtatctgataggagtgctcgtgaaatgaaataaaatgatgttattaccagaataacaaatatagaatttagctaacatatatagttaggttaaaatgtttttatataaatatttaatagaaaattacattctccttacattatagttagcattaacgattaagatgatataataaaatgatcaaatcttattaaatatctgtctaaaaataacttaaactaatataatcggtatataaacttaactcttaaatacaacagtgattaaaataaaatcaactttatcaattattatatttaaaaaattaaatagaaataattttatgaaaaaaattactataaaatgcattgataatattgaatactaataatttttaatagtttgtttttagaccaccaaaccagaatcaatcaagggagggttatttcagcttaactaagtttttatatattattttatttatttcataagattaaaatctcaagtgagatacatgaatcaaatagtagtacttttttttagaatatattaattgataatttaatgtcccagttagcagaagacaggtgggagactatcttactttgtaggccacaaggatcaatgcatgatccgcagcgcttataaatacgtgatgggacgaaagaatatatttttaagttgtggctcaaaagcaattactactaagaaaggataaaggaaggaaggaacacttttctgatattctttttggtattgggttgctgacctttgctagtgttatagattttttgggttctcttgtgttttaataaatacaggaaaaaaaaagtatataggtgcctagaagaaaagacaatatagggtgtggagcaattacgtttgatcacaagggaaaaggtgcaacggtttgcaagatagcatagaagattttgaagaatcttaattgcaacatagtagtgcagttgca

SEQ ID NO: 102 - DNA, 3000 bp, Arabidopsis thaliana
gatggaattgtctttgtagaaaagtctagtctttgctatgtttctaacggtctttggtttgtttctcaatgttcaataatgttatgtaatggtaaatatttagcagcggtatagttcattctcttgatatcggtttcaaatttttatttgaggttgaaaccacatgaacatggtcgatagtctggtcttttttgatgttaacattcatataacaattagtttagattgagctgtggtagaattttgagccagtgctgctaattggagtttgtggtaatctagtaattaccaaatttaaccaaacaatgaaaatgacgttgtcctttatatcatcaatcaggggaatgggaatgaatattcctctttacttttcaacctttttttattcaccaaactaatttcttcatgactctgtcataccaataagagaagccatacgacattttttttattttgtggcagactcttatgtgtaaattattttgtgaccaactcttgctggtcggttattctgtggaaccgacattcccatgtgctccaaaccgaaccaaaccaatatgttccactacttcctttcttcttcttatgaaattgttttccatgattttgttattattcagttctttttaagtgcgatgatccataaattcggttcaattaattctcactttataaacactctaaatatcatcaacactatataacctcagtttttgtatgtcgttttaattctgtcatcagctttgatatgtttaaccaacatgattttgtatataacaatagtttagcgatttggttgttctccttaaatagagatccaccaagtcatatgtgatgtggacaccgttttgaccggaaaagtcgacgaattatcatgtttttcaaacaaacttgacgtaaaaggttcaattctttgtttgcaacgacgaactcatgatcacttctcgaccgaatctacaacgaaacccatatgtttcttctacccaaaaaaaagtaaaaagagatcttcgagtcatgttgacctttacgacttcaactcatatttgtcctttcaaaatttgtcatggccatattgttgtctcatggagaaacacttttgagccaacagtcggaaaacaaccatcacttagcatttttttatttttaatactactatttttttttttgtaattagtcgagtgtaccaatcccaaatttaatgggtatctttcataaccaaaaagaaaaaagcacaaaaacaaaatactactactatactataatggtgaaacacacattacattagcattaaccgctattccttaaaagatatatgagcagactacaaggaagtacatttaaatcagtgtgctaagttttctcaattatcaatctaataattgtacttacataaatttaccaaatcatctcaccatttagggcatacaatttttgctcaataatggagcttgaaaagactaattatagaatgtctttttggttgacacaagctcgcttcttcatgtcgtttactttaaaaattgtagattctttcacaacttataagattctatagcctatttgattatcctttaggatgatgagtataatatctcaaactataaaataaaaatgttcacatcaataattgaaaaaaaatgcatgtatgaattcacgaaaatatggttacggttgtgtgttgctgctagacaaaagtctttcatatattcagttatatttcttaaaactaatcaaaattgttttatgcaattttggcgagtagagagaaaaagcgcgtgggataaataaagaaaggcgttataaaaaaagagaaaaagtcaaccgagtagttctggtaagagagtctcgtgcattcgtaaggtttccaagagtccacatatctatttcatcatcctcttaacgtttttctcacttacttttttccccactcttaattgattccgttgataaaatttgttcgttatatagaaataatcagaatataattagggttaattttggagtaaagaccattcaatcaatggtttggcttgattcttgtttgaaattctatgtttaaaaagggtaatacttacaaacttgactttattagtattttaaaaaatgacaaaacttaaaatggatttgaaatctagcatatttaactttaatacagttttggtttaagtttcactctcttttctatcaaaaatataattttaaaatttgaaagatgttaaaatagacaaatgtcattagtttgttcagatttagttatgtttttaatatacagacaattatattaaaataataataaaaaagtcagatcagttataaaagaaagtcagttcagttttaagacttaagtttgagtcttttggatttgaatttaatagattcacttttattaaaaattgttgaaacactttttaaaaactaaaacatttgtcaaaaaatgcatttaaccaaaaaaatgaaaatgaaaggtagtaagtaataaaagaagaaaacaaaatctaaaaaagtgtctttaaaatctcaaaattaaaatatacaaaaaagtacaagaaaataaaagaaaagggggaaaaagagagtcaatatcaacatgcaagtgtgaatattagactcttcttctctcatcagttaccccaaaactagggtttacccattttcatcatcttcttcttccccacatcactctctgaaagacaataagagagagagacacacacaccaaaaaaaaaaccccattgatttttaagagagagagagagactgagaacgaagagcaaatgagagagaagttgaatcaaatttccgctttcgttctctttctctctcctccatttcagtaataaacactccttcctctttaatttttctgggtttcttcttcttccctcttttgttgtttctgtgtgattcagttctcgatccatcttttcgtgaaaagtatcaatcttttaattctctagttgtttgtcaaatctggttagtttcttctcttgtatttatttg

SEQ ID NO: 103 - DNA, 2983 bp, Zea mays
taatgaggcataagggcatgtacaatcccataattaagagactctaaagattatgtaaaaaattaaaaagatagactctttgtgaagagtctgtctctacacgatagagatggcgatgagacccgatcttcgatttctcgctgggtattcttcattaggtggtgtgaatgtgaaaatttcttccccacggagatataacacagagaaaattcttccgcaaagagtaacccgttaaaccatgtgacgacgacattttcatgtaatagttaatgataaaaataaataattatgttgttaatatattatttattctataaatgtgttttttaatgtacacataatgatttcttacatctcaaaatgtatataagcgacaaagttttgcattaataacatatgaagtacatcataattagaatttaaacggggaacgatggtggagaataaatgtccccgcaagcgttcgtagggatctttgcgggatttttttttcgtcgcgggcccgaggatgggagctaaaacccaacgagaaatttctcattgctatccctactacacgacactatatatatgtattgtgtattaactgtatttatgatctaaaaattcataactctatcgtatagtctctcttagttatctctgtacctatcgatccaagagctcatgcttgtacatatcctaacaaaagttaggcaacgataccgattgctatagcttctagggacatttcattgcggcacatttacgttgggaaacaaactatcagggtgtacattgtgttgtgtgcattcatggtacgtaggcagagcgttgaacatcatgttttaatgtttatcatcagatataccgttgttccgactaataagtaaattgtacataaatgtacaatatttttttaaaaaacatgtagtcagagctcataagtttatccgtcaatcatttaaaaaagatatatttgaattggtaattaacatccacacaacgtcattagactttgtttggaaattaaatgcccttggcaatttgtaactctatgaatctgttattatttttgttcgaataaaatgcattcgtcgaagtcgtatgctgacacctaccagtgttcagaacgacattcatttatcgctggtggtggtaatatagatttgatttttaaactctaagcacaagacacaattaaggtagatacagtggtgtgtctaaaacctattatatcttactacatttatttcaccaatatattaatcaactacgtcttctatcttgaggctacaaacaagagacgtgtgtttttttttttgcatttagctcttagacacgtacatgctctaaggaaggaaagcatcacaattccatgttagtacgtgtctttttttttcatttttctggcagagcacttacttgtaatgacattactttcctttcgacatgtcgatgtttttgaaaaaagaaagataagcttagtggtattctacgaaagacagtagaaaacagatactctcacatatatctacataagtatactaaccacataaacattttagaaagttggcgaaggacgactgtgaagtcaccgcaagaatttggatatcggagtataacctatcacataaaacaataatttgctaaaaacacacacacacacacatgacccatacggtgttagtactcgaatatgcatgcatggtgtacatggaacatacccaagtgtgccttgctgatgagaaacccatgttctaggggagatggcttgacgctaatgcctagacggggcatttatgagaataaatgtggatgtggcgcccatgcattttcgatccaaccatgcggaaaatgatagccagcattgtagtattaggagtagtggttagcgagaggaagtagggaggccgagctggtcgtgaggcggacctgctgagcgtgagcgggcgccgccgccgcccagcagcagaagtccggtccggtccatccagcggagccaagacgccgacggtagtacctctcaccaaacaaaggaacgacggaggcagcgcctcaatattcgtgtgataacgcctctgccaggcgcgtgggcccaccggtccccgcacagctcggtccgtccacctcggcagcattcactcgctgggtcagcggccccaacggcctcggcctcggcgtcggcccggtgtggtgttgtgttcttccgttccattcccccgtccccgtccccgtccgtccccccgcccggctggctggctggcatgggtcgggtcggcattgaatcgccgcaccaaacccccgtcggatccagatcacacggccccccacagtctcgaccccatccttccagcacggagtcggtgacgacaaacaaggcaacaaaataagcggcccgccccctttgactgcgctccctgcctgtgtgcccgagccccagggcccaagcgcctctctctctctcatcagcagcgacaccggggaggacaggggagcgtcagcgccgtctccactctctctcgaccgaccccatcccttcccttccttcccttgccccccccagcctttttcatgcgtccacaccacacgcacgacgggactcttccttcgctggacgactccctgtgcccgtctcgtcgtctcctctcctcacctcccctccacccccacttgctattttgaccctcctcccgttcctttctttaatccatcatccgcctcgctatccctccctccctccctccctgcccgccgtggagggtttgggattttgcggacctcagcagctccatatctcagtcacacactcacgcgcgcgcgggggccgggggccgctggacccgccgttctccttctcctccccccctcgttcctctcgtctcaccactactaccctacacgcgccgcggctaggattccgccgaggagacgctgcgcgcgtggatctccggtgctgtcctgctagcgtgcgacgaggccaggcaggcgcgcggccggcgcc

SEQ ID NO: 104 - DNA, 3000 bp, Oryza sativa
aaatcaaaggaaataaaaagattgaagatcctaaggattcaggtactatagcaccatttggtttacttgaatcagtcactaaaagcaaaggaaagtttcctactcgagcgatttcaaggggaaaaacgtgggggaaaaaacatgcactatgagctttttttctttttctttttcttcccgtgggtcgtgggaatgacaagcgaagtgcgatcacgtgatggccatagacttactgtattgatttatcatagctttactttctagtatattcattaacatgcatgtaaagttttcaacagtgtaccttacgatatctacaagtctttatttgttttataatccctattttacacaagcaaccgtgtccaatttctatgtccttttctaatcaccgttctaaaggtgtccttcaagtttatttcgtgttgaagcaggagacaaactccatcccctattcgaccgaaacattttctttctcaccaaccaaagagggttttacttatggtaaatacttctcgacttgtacttctaaccaaaaaggttttacttgtagcaaatactttttgactcatgagacatataaatttcaaataaccgacgcttggaaagaagtgttagagcctactacaagaggaaattaagtgctattcaaatagggctgatggagcgtgaagattagaaatcgtttttatgcatcggaagggaaataaggaccatccattggcaagcacttaaggacaatggctggattaatgaactccggcagcttattcatgatccatatccaaccttctcccatctgcttatgccttggactaaccatcccttagagggtattgtgaaaagatccttgattcctaatgaaatgatgaagtagtggtgtgatatgtcgtcgagcgaggaatattccttggaaagatgcctcgggaaccactctaaccactcttgcaagctagcgccaaaagatatggggaccacataaatgtacaaccatacccttaggtttttagcatgacatggatattgtagtaacttcctatgtatcctccggggtaagattgtaacttcacatctacctccagggactgtgtaagccggtaataatcctgtagcacgacacaaacataatcaatagtaaaataacacactacttgtacatattaggctttgcatttcgagttcatctcattttcatgatatgcgggggaaataatatctcctcacctatcccctatttatctgtgacaagatatgatagatctatttattttggatggagggagtagataaacactaaccaaatacaggaaacataggttaaagtgtttggatgacgctaatgcagatgaacccgaattcatgcgtcacatgaagcgacagataagatttggtacctaccaaccaggggctgtccatccaaacttcacttcctacaagactggaaagccggactgtgatcaaaattgggcataccatgcctgatgattggccacatccagccctgtttatgacgcgattactgacccatgaacaaccaatgaagattctatatcaggtcgtaggatatcttgacagcaacagaaacaccaaacgatcgcagcatggcaaaaattaaacactctccaaagatggggatggtacgaaagataggccgagctggtcgtgaggcagacgcctcctcctcccccgagctcctccccggtccagcccagccagccagccggaccagccaggacggttcccttccacctactgtaacaccattgaagcgcctcaatattcgtgtggagcaagccgctgacgccgcccccaccgtcggatccgcggtcgggccccacatccgccgttcactgggccgccggacccaccgcccacgccgcggccagtggctacgcgctgcattaacgcccgcctccataacctcccccctcctcatcccggatctacgcgtgcgtggggcgaaagacactgaccgtgggcccttcggctaccgtggggcccagcgtcatggactggctaggctagggagctctgtatgaggcatcctgtgttttctctggggcgcattcaattctgcaccaaactgcaacccgtcggatacagatcacacggcccccacacccgcgcggctcgcccactgaccatgggcccacggacgccagcccaaccccggcctgcacaacgtggcctcgccatctcccgaccgctcgatccccccgtgtcccgtccgtccccgtagatcaccggagagagatcataacggccacgccggcacacggcgcgtacggcgcaccggtggaggagaggaagcgggcaccggcgcctctgacccaagagagacctgaccgacccctcctctctgctgtgcacttcacccgcaccaaggcaaaaaaaaaaaaaaaaggcgacgcggaacgcaacaaaatactaagcgcgcacgcatccatccggccgtttgaccgcgcaacccggctgctgctgccgctgcctgcctcagcgtcgtcagcgtctcgccatccccgcccccacctcacccccacgctccgctggttctatttttctctcgcgtccacacgacgggggggcctcctctcctctccctcctcccctcgtctccacactagacttgccattttgaccctccgcttgctccctcctcccgttcctatctccccgccgccgtacataagtgctttctttaatcggatgcgtcccctcccctcgccaccagttcgttcgctcgctcgctcgctcgctcgccttgttaatctatccctccctctctcccgcccctccgtccgccgtggagggttagggttttgagggttcgctcgcctcggcgaggctttatctctctaccagtagtctcttactcttcttcgttgggccgtgggttaggaatcgggttgtgaggcgtgtgggaggggcggggtagatccaaggaagaggactttctcgagtttacgccgtggtgttttgcttcggcgaggaggcggcggc

SEQ ID NO: 105 - DNA, 8964 bp, Artificial
  PHP87078 T-DNA
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 106 - DNA, 11217 bp, Artificial
  PHP87598 T-DNA
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctggggggcactcacgacaaccgtgaccctggcgtcgacaagagcgacagcggatgggttcccggcaagcagcaatttggtgatcagtggcgaagcagcggaagcagccgaactgttttatttttgtgggggagcgacgagagggagaggtggatgagcgggcttcaacagcgccgagcaatagcacgtcccggacgagagggaataataaatttggattttatatttctaagtgcactctgaatttataagtttataacatttaggggctgtggtataactgaataagttcaaaaatctaaacaagtgttttttaagtttagaaaccggaatgatataatcagcaaccgaaataacatagataaataagtttgagttctaaaacgatggtatttagaggacgcgatgacacggctgaatcacggcccaggcacggcccgtgataagttcattgcgattctccgccacagagcaaaggcccacgaaactcagataatgtcgaagcgggttgaggttagagcgcacgagaatgttcaagagaagccgacaagcgtggagaaccccgccccgccgtcgcgaagctctctcccctcgcactcccgggaccaggctacggcatctgtccggtagcttcaacgtctttccccatccttccacggcactcgtgacttgacctataaaaggagccgtcgatccacggtctccaaccaggaaagcaaagcgcttcgcaagcacaggcagtgatccgtaaccaaatccggacagtcttgagctctctcagtctcagcatttcagttcccagatctacatagccccagcccccaagtagcgcatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgatccgatatcgatgggccctggccgaagcttggtcacccggtccgggcctagaaggccgatctcccgggcacccagctttcttgtacaaagtggccgttaacggatcggccagaatggcccggaccgaagccgaggccggccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatgggaagaagggcatgctgtgcgaaagaaggcgtgaagagaggcgcctggacaagcaaggaagacgacgcgctcgcagcatacgtgaaggctcacggagaaggaaagtggcgcgaggttccacagaaagctggacttcgcaggtgcggaaaaagctgtcgccttcgctggctcaactacctccgccctaacatacgccgcggcaacatcagctacgacgaggaggacctcattatccgcctccatagactcttggggaaccggtggagccttatagcaggacggctcccaggccgcaccgacaatgaaattaagaattactggaacagcacactcggcagaagggcaggcgctggagctggtgcgggaggaagatctacgatggcactgtcagcaagcagagtgcagcaagcagaggaactcctgcagaggccagcagaacgccagctcatgagatctcagcttgccgctgctgcaagaagcatcaactggtcctacgcgctcttctggagcatatcagacacccaaccaggagtcctgacatggactgacggcttctacaacggcgaggtcaagacccggaagatctcgaactccgtcgaactcacctccgatcagctcgtcatgcaaaggtccgaccaactgcgcgaactctacgaagccctcctgagcggagagggcgatagaagagcagctccagcaagaccggccggaagcctcagcccagaggacttgggagatacggaatggtactacgtcgtctctatgacatacgcattcaggcctgggcagggactcccgggtagatcctttgcaagcgacgaacacgtgtggctgtgcaacgcacacctcgcaggcagcaaggcatttcctagggccctcttggcaaagtcggccagcatccagtccatcctctgcattccagttatgggcggcgtcctcgagctgggaaccacagatacagtgccagaagcacccgacttggtgtccagagcaaccgcagccttttgggaaccacagtgcccatcatcctcaccctcaggccgcgctaatgaaacaggagaggcagcagctgacgatggaacattcgcgttcgaggagctggaccacaataatggaatggacgatatagaagcaatgacggcggctggcggacatggtcaggaggaggagcttagacttcgggaagccgaggcacttagcgacgacgctagccttgagcatataaccaaggagattgaggagttctacagcctgtgcgacgagatggacctccaagcactcccactccctctagaagacggctggactgtggatgctagcaacttcgaggtcccctgttccagcccccaaccagccccacctccagtcgacagggctacagccaatgtggcagcagatgcctctcgcgccccagtctacggctccagggcaacttccttcatggcctggacccgctcgtctcaacaatcgtcctgctccgacgacgcagcccccgctgcagtcgttccagcaatagaagaaccgcagcgcctgctcaaaaaggtggtcgctggaggcggagcatgggaaagctgcggcggcgcaacaggtgcggcgcaagaaatgagcggaacaggcacgaagaaccacgtcatgtccgaaaggaaacgccgcgaaaagctgaacgagatgttcctggtcctcaaatcccttctgcccagcatccacagggtgaacaaggcctcgatcctcgcagagacgatcgcttacctcaaagagcttcaacgccgggttcaagagctcgagagctcaagggagccagcctccagaccatccgaaactacaacacgcctcataaccaggcccagccgcgggaataatgagtccgtgagaaaagaggtctgcgcaggctccaaacgcaaatccccggaactcggcagagatgatgtggaacggcccccagtcctcacaatggacgccggtactagcaacgtcaccgtgacagtcagcgacaaagacgtgctgctggaggtgcaatgcaggtgggaggagttgctgatgacacgcgtgttcgacgccatcaaaagcctccacctcgacgtcctgagcgtccaagcctctgcacctgatggatttatgggcctcaagatccgggcacaattcgccggatcgggggcggtcgtcccctggatgatctctgaggcactccgcaaggcaattgggaacccctgggtcgttgttgctccggatacaggatcgcacgcaacaccggcagcaaccagcggtgcgtgtgaaactggacaaaacagcgctgcccacagagcagaccctgattcggctggtacaacaactacatccgccgcagctgtgtgggcaccgaaggctgtcagatgtacaggcgggctgttcttcttccacagagacacaacacctgctcacgcgggagaaacagcgacccctatggctggtggaggaggtggtggaggcggtgaagcagggtcctccgatgattgcagctcagcagcatccgtttccctcagagtcggttcgcacgacgaaccatgcttctcaggagatggtgacggggactggatggacgacgttagggctctcgcatcattcctggagtcggacgaagactggctccgctgccaaaccgctggtcaacttgcctagcgtaccactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttggcgcgccggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 107 - DNA, 8924 bp, Artificial
  PHP88156 T-DNA
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaaacaacgtaagcgcttacgcaccgaacaacgtaagcgcttacgcaccgaacaacgtaagcgcttacgcacccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagccgaggccggccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggggaggagggcgtgttgcgcgaaggaaggcgttaagagaggggcgtggacgagcaaggaggacgatgccttggccgcctacgtcaaggcccacggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagatccacgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatttccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtgtccatgacctacgccttccggccaggccaagggttgcccggcaggagtttcgcgagcgacgagcatgtctggctgtgcaacgcgcacctcgccggcagcaaagccttcccccgcgcgctcctcgccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagacgggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggatagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcacgatggacgccggcaccagcaacgtcaccgtcaccgtctcggacaaggatgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaacccctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctggagtccgacgaggactggctccgctgtcagacggccgggcagcttgcgtagtggccaggtaccactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttggcgcgccggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 108 - DNA, 8870 bp, Artificial
  PHP88157 T-DNA
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaacgtaagcgcttacgcccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagccgaggccggccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggggaggagggcgtgttgcgcgaaggaaggcgttaagagaggggcgtggacgagcaaggaggacgatgccttggccgcctacgtcaaggcccacggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagatccacgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatttccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtgtccatgacctacgccttccggccaggccaagggttgcccggcaggagtttcgcgagcgacgagcatgtctggctgtgcaacgcgcacctcgccggcagcaaagccttcccccgcgcgctcctcgccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagacgggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggatagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcacgatggacgccggcaccagcaacgtcaccgtcaccgtctcggacaaggatgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaacccctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctggagtccgacgaggactggctccgctgtcagacggccgggcagcttgcgtagtggccaggtaccactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttggcgcgccggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 109 - DNA, 8870 bp, Artificial; identical to SEQ ID NO: 108
  PHP88158 T-DNA

SEQ ID NO: 110 - DNA, 7799 bp, Artificial
  PHP86491 T-DNA
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 111 - DNA, 9132 bp, Artificial
  PHP81561 T-DNA+
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgaagcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagcttgtttttctcagacagttttctaaaaaaagggcgtttctggggaagttcgagatggttcgtaaggtgttactggctcctgtgaaccaatacatgatactgccatgataagggttataattagtcaagcagagtaagaagaaacaacagtagcagtgactccgattcctgaagatgagtcatatttgtcttgtgctcctgctgtatgaaatggatcgcatgtgtatattcgtcgccgcgccgcactggtgtaacctgttgcctcagagtttgcttttagctggttctgttttaaaaataagtactgttttttggttggctgcaagccattctgaacttcagtttaccaattgtttttatgttgtggttgaatattttaattttttatttaatgtttggttctttttttatatatatttgcaaaaatgatacaagtggtcaagttttcatatagtatgggctctatttcctagagctctacctctaggaacgaattttgtggaggttttcttttggctagttaggcaaagtccccatatcttgcaggctaaatcaagaagaagctctgtcaaacagttttttttactgaaaagtgattaaagagtagtttctcctagatcacttcagagtttatcctagagaatcatgggaatcaaattcagttagaggatcatttcttacaaagaatcaactttcgtagagaatctaaagcagaaagagctttgacaaacttacccttagagcaattccaacattctcgcgtgagtttcttcgcgccgttgttttgcggtgacttcatctggacgtcccgcgacatagagacgcttgtattgatcatgagagcttgtgtggtcatacacaatataattgttaaagatgaaagagatgtggaccttaatgagcgattcgactttgatggtgaaaatgtgcaaccttctcatggtatttctactcgcacactagctgaatttattgaagctcataaaaagatccgagacaaagaaatacattttcaattgaaagaagacctaatcaagcacttatggaagcttggtcacccggtccgggcctagaaggccagcttcggccgccccgggcaactttattatacaaagttgatagataaatcagatatctggttcctaaggacccggcggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccgcccatggtcgaacaggacggcctgcatgcaggatcaccagcggcctgggtcgaaagactcttcggctacgactgggcacaacagaccatcgggtgtagcgacgcagctgttttcaggctgtccgcacagggcagacccgttttgttcgtcaaaacagacctgtctggcgcgctcaacgaactgcaagacgaggccgcaagactgagctggcttgctaccacaggcgttccttgtgctgcagtcctcgacgtcgttactgaggctggaagagactggctgctcctgggtgaagtcccaggacaggaccttttgtccagccatctggcacctgccgaaaaggtcagcatcatggcagacgccatgagaaggctgcacacactcgaccctgcaacatgccccttcgatcaccaggcaaaacacaggatcgagcgcgcaagaacgcgcatggaggctggtttggtcgaccaagatgacctcgacgaggaacaccaaggactggctcctgctgaactcttcgccagactcaaggcgagaatgccagacggtgacgacctggtcgtcacacacggcgacgcttgtctcccaaacataatggtcgagaacggacgcttcagcggtttcatcgactgcggtagactcggagtcgctgacagataccaggacatcgccctggcaacacgcgacatcgcagaggaactcggaggcgaatgggctgacaggtttctcgtgctctacggtatcgctgctccagacagccagaggatcgcattctacaggctcctcgacgagttcttttagttcgaacggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 112 - DNA, 19157 bp, Artificial
  PHP86295 T-DNA+
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtacctagtacccttgtacttttggtttcacctgcatagagaaaacccacaagaatatgacagtctgatttgtcagtctcattctcaagcaacatttctctatccgttactttcatggtgaataacacaatccatcatcaatactttgtgttactcagaaactgaaagttattccgagtcttgcatatctttggacctactcgtttttctaccattattgctgattgttaagctctcgctacttgaatcggcattgttggagtgggaaggttcaaaaaattggagttatgactagttgtctctttctatgtacgatggagaaaatgaataaacaactgagaaaatggctcttgtttagttgatgatgctcttaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgcgctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgaacgagaaacgtaaaatgatataaatatcaatatattaaattagattttgcataaaaaacagactacataatactgtaaaacacaacatatccagtcactatggtcgaccgacagccttccaaatgttcttctcaaacggaatcgtcgtatccagcctactcgctattgtcctcaatgccgtattaaatcataaaaagaaataagaaaaagaggtgcgagcctcttttttgtgtgacaaaataaaaacatctacctattcatatacgctagtgtcatagtcctgaaaatcatctgcatcaagaacaatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatccacgcggcgtttacgccccccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttacggccgccatagtgactggatatgttgtgttttacagtattatgtagtctgttttttatgcaaaatctaatttaatatattgatatttatatcattttacgtttctcgttcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactagcgtggcatttggcaccgccgcacactatgcgagctaggagtgctagtttacagatgaaactatgaaaccaagaaaacacaattgtccgtagctagcgcgtggcgtcgtgtcaagcttcacacagtatcttcgttcttcactataaatcgcgcctgttgttcgtgagacccaccaccgtggataacagtcccctaataataagcgatcaacagcactgctgatggctgaacaccgaggcgccgccgcgcgtaaccatccgccggagcagcccgtcgtgccggcgaacgacgccttccccgaccgcgcccagcagctctgcctcgacgccgggcgcgcgctcgcgatgtgcggcgtgctcgtcgccgtccctcccgcattttacgcgtcgacgtcgcggacgacaccgcacttgccttcgtcggcttcgtcctctggatcatcggtgcgtggctgtgcctcctggcgctcacgcccttggctccacgggcggtgagggcgggcggggccgccgccagcaccttgctgatcaggtgcctgtccctttcatgaactactagcgcccgcgcccgcggccgccgggcacaagagaacacatcgatgttcgctgcgtacgtcagcaataaggcactctttgtcagtagtcgagtgcatatgttgggtgtttgccctgggagatttcaagtgttgtggccattatcccgcaggataaaaaatcggcggcttttggattgatacggaaaataacgatgtttcatgctcgtgttgtgtgtgtgacatcttgtcagccaagtttttaaccgttgctactccccctctgtgggctcagtgtgtggaccggaatacgtcgtacataggccgtagcctaagcccaatatgccgtttttcaggttggcctgtgtgacgacaagcgggtctcaaaagcccatcacgcaactggcctgcaattattggaggagagcgcgtcgagttggttccagaggctgcgtggtggggccggactctgcgacgacctctcgttcgcgtccgatttggttgccgtgagccgtgacgtaacgcctccttccgttcctccctatataagttccacccccgggtccggtttccccaagccccagtgacccccgatcccgatcgcgaaatctccgcacccgccggcaagggaccgaagcaagcctctctcccgaccgtcgcatcaaggtacgcgtccgctcgatctgtcctcttccttctcgatttgacttgctgtggtgcccgatcacgggatcagaatcgcaccagtgtagatttcgcatgttctaagatgtgttagtttccaggctaatccagttctcttgacgcccgatccgatcgagctccgtgtttatttcagcctaatcgtagtattcccctaaaatttcctcattagggggttcgcaagattgttggtcgacaggttcacttatgctcgatcgcttacttttagtcgattcatgctgcgtactattgttgccccccgtggttttatcttttctcgtgtgaaatccagtagatatagtagatatcgtagcattaggttttaattcaatcgattgattattgtatcatcaaaattgagaagttcgaatcatgcctatcatgctgcctcaaccgaaatcctgtatattgaagtttcaattcaattgattgatcattcattagattcaaccaaaatctagaaggttagatgacgcatgtcatgctgcctgcgtagtttacctttgatctgtttatgattaccttatcagtaggatatttgtgattttgggaagtagcactaactgattcatgctgacatgatgttccctttcagattatactgttgagtcctatctaattgatgctttgtatgctatatgaatacgtcatggtaaattagcagttaattagcatattagcaattgggcgtacctcatcaggattgctcttgtagatgtgtgtggtgatgtttcttgttcaattcatgttctgctttaaaagtatgtgttctctgtttgttaattaagattcatggttataatgatttggacctaattaatcagggttgcccttttagatgcgtggttacttgttgagttcatttttttcctgctatagttgtatgcgtttgttcattcatggttagatttgatttgtttcttctctattccatgccttccatatacttcaattgtagcttaacatgagatttctgtatatgcaggtcgaccgccggggatccacacgacaccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacatacctcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctcaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgataggtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcaccacggaccgaacccgggaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggaatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcacc

SEQ ID NO: 113 - DNA, 15091 bp, Artificial
  PHP86296 T-DNA+
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtacctagtacccttgtacttttggtttcacctgcatagagaaaacccacaagaatatgacagtctgatttgtcagtctcattctcaagcaacatttctctatccgttactttcatggtgaataacacaatccatcatcaatactttgtgttactcagaaactgaaagttattccgagtcttgcatatctttggacctactcgtttttctaccattattgctgattgttaagctctcgctacttgaatcggcattgttggagtgggaaggttcaaaaaattggagttatgactagttgtctctttctatgtacgatggagaaaatgaataaacaactgagaaaatggctcttgtttagttgatgatgctcttaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgcgctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgaacgagaaacgtaaaatgatataaatatcaatatattaaattagattttgcataaaaaacagactacataatactgtaaaacacaacatatccagtcactatggtcgaccgacagccttccaaatgttcttctcaaacggaatcgtcgtatccagcctactcgctattgtcctcaatgccgtattaaatcataaaaagaaataagaaaaagaggtgcgagcctcttttttgtgtgacaaaataaaaacatctacctattcatatacgctagtgtcatagtcctgaaaatcatctgcatcaagaacaatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatccacgcggcgtttacgccccccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttacggccgccatagtgactggatatgttgtgttttacagtattatgtagtctgttttttatgcaaaatctaatttaatatattgatatttatatcattttacgtttctcgttcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactagcgtggcatttggcaccgccgcacactatgcgagctaggagtgctagtttacagatgaaactatgaaaccaagaaaacacaattgtccgtagctagcgcgtggcgtcgtgtcaagcttcacacagtatcttcgttcttcactataaatcgcgcctgttgttcgtgagacccaccaccgtggataacagtcccctaataataagcgatcaacagcactgctgatggctgaacaccgaggcgccgccgcgcgtaaccatccgccggagcagcccgtcgtgccggcgaacgacgccttccccgaccgcgcccagcagctctgcctcgacgccgggcgcgcgctcgcgatgtgcggcgtgctcgtcgccgtccctcccgcattttacgcgtcgacgtcgcggacgacaccgcacttgccttcgtcggcttcgtcctctggatcatcggtgcgtggctgtgcctcctggcgctcacgcccttggctccacgggcggtgagggcgggcggggccgccgccagcaccttgctgatcaggtgcctgtccctttcatgaactactagcgcccgcgcccgcggccgccgggcacaagagaacacatcgatgttcgctgcgtacgtcagcaataaggcactctttgtcagtagtcgagtgcatatgttgggtgtttgccctgggagatttcaagtgttgtggccattatcccgcaggataaaaaatcggcggcttttggattgatacggaaaataacgatgtttcatgctcgtgttgtgtgtgtgacatcttgtcagccaagtttttaaccgttgctactccccctctgtgggctcagtgtgtggaccggaatacgtcgtacataggccgtagcctaagcccaatatgccgtttttcaggttggcctgtgtgacgacaagcgggtctcaaaagcccatcacgcaactggcctgcaattattggaggagagcgcgtcgagttggttccagaggctgcgtggtggggccggactctgcgacgacctctcgttcgcgtccgatttggttgccgtgagccgtgacgtaacgcctccttccgttcctccctatataagttccacccccgggtccggtttccccaagccccagtgacccccgatcccgatcgcgaaatctccgcacccgccggcaagggaccgaagcaagcctctctcccgaccgtcgcatcaaggtacgcgtccgctcgatctgtcctcttccttctcgatttgacttgctgtggtgcccgatcacgggatcagaatcgcaccagtgtagatttcgcatgttctaagatgtgttagtttccaggctaatccagttctcttgacgcccgatccgatcgagctccgtgtttatttcagcctaatcgtagtattcccctaaaatttcctcattagggggttcgcaagattgttggtcgacaggttcacttatgctcgatcgcttacttttagtcgattcatgctgcgtactattgttgccccccgtggttttatcttttctcgtgtgaaatccagtagatatagtagatatcgtagcattaggttttaattcaatcgattgattattgtatcatcaaaattgagaagttcgaatcatgcctatcatgctgcctcaaccgaaatcctgtatattgaagtttcaattcaattgattgatcattcattagattcaaccaaaatctagaaggttagatgacgcatgtcatgctgcctgcgtagtttacctttgatctgtttatgattaccttatcagtaggatatttgtgattttgggaagtagcactaactgattcatgctgacatgatgttccctttcagattatactgttgagtcctatctaattgatgctttgtatgctatatgaatacgtcatggtaaattagcagttaattagcatattagcaattgggcgtacctcatcaggattgctcttgtagatgtgtgtggtgatgtttcttgttcaattcatgttctgctttaaaagtatgtgttctctgtttgttaattaagattcatggttataatgatttggacctaattaatcagggttgcccttttagatgcgtggttacttgttgagttcatttttttcctgctatagttgtatgcgtttgttcattcatggttagatttgatttgtttcttctctattccatgccttccatatacttcaattgtagcttaacatgagatttctgtatatgcaggtcgaccgccggggatccacacgacaccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacatacctcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctcaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcgg

SEQ ID NO: 114 - DNA, 17616 bp, Artificial
  PHP86297 T-DNA
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtacctagtacccttgtacttttggtttcacctgcatagagaaaacccacaagaatatgacagtctgatttgtcagtctcattctcaagcaacatttctctatccgttactttcatggtgaataacacaatccatcatcaatactttgtgttactcagaaactgaaagttattccgagtcttgcatatctttggacctactcgtttttctaccattattgctgattgttaagctctcgctacttgaatcggcattgttggagtgggaaggttcaaaaaattggagttatgactagttgtctctttctatgtacgatggagaaaatgaataaacaactgagaaaatggctcttgtttagttgatgatgctcttaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgcgctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgaacgagaaacgtaaaatgatataaatatcaatatattaaattagattttgcataaaaaacagactacataatactgtaaaacacaacatatccagtcactatggtcgaccgacagccttccaaatgttcttctcaaacggaatcgtcgtatccagcctactcgctattgtcctcaatgccgtattaaatcataaaaagaaataagaaaaagaggtgcgagcctcttttttgtgtgacaaaataaaaacatctacctattcatatacgctagtgtcatagtcctgaaaatcatctgcatcaagaacaatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatccacgcggcgtttacgccccccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttacggccgccatagtgactggatatgttgtgttttacagtattatgtagtctgttttttatgcaaaatctaatttaatatattgatatttatatcattttacgtttctcgttcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactagcgtggcatttggcaccgccgcacactatgcgagctaggagtgctagtttacagatgaaactatgaaaccaagaaaacacaattgtccgtagctagcgcgtggcgtcgtgtcaagcttcacacagtatcttcgttcttcactataaatcgcgcctgttgttcgtgagacccaccaccgtggataacagtcccctaataataagcgatcaacagcactgctgatggctgaacaccgaggcgccgccgcgcgtaaccatccgccggagcagcccgtcgtgccggcgaacgacgccttccccgaccgcgcccagcagctctgcctcgacgccgggcgcgcgctcgcgatgtgcggcgtgctcgtcgccgtccctcccgcattttacgcgtcgacgtcgcggacgacaccgcacttgccttcgtcggcttcgtcctctggatcatcggtgcgtggctgtgcctcctggcgctcacgcccttggctccacgggcggtgagggcgggcggggccgccgccagcaccttgctgatcaggtgcctgtccctttcatgaactactagcgcccgcgcccgcggccgccgggcacaagagaacacatcgatgttcgctgcgtacgtcagcaataaggcactctttgtcagtagtcgagtgcatatgttgggtgtttgccctgggagatttcaagtgttgtggccattatcccgcaggataaaaaatcggcggcttttggattgatacggaaaataacgatgtttcatgctcgtgttgtgtgtgtgacatcttgtcagccaagtttttaaccgttgctactccccctctgtgggctcagtgtgtggaccggaatacgtcgtacataggccgtagcctaagcccaatatgccgtttttcaggttggcctgtgtgacgacaagcgggtctcaaaagcccatcacgcaactggcctgcaattattggaggagagcgcgtcgagttggttccagaggctgcgtggtggggccggactctgcgacgacctctcgttcgcgtccgatttggttgccgtgagccgtgacgtaacgcctccttccgttcctccctatataagttccacccccgggtccggtttccccaagccccagtgacccccgatcccgatcgcgaaatctccgcacccgccggcaagggaccgaagcaagcctctctcccgaccgtcgcatcaaggtacgcgtccgctcgatctgtcctcttccttctcgatttgacttgctgtggtgcccgatcacgggatcagaatcgcaccagtgtagatttcgcatgttctaagatgtgttagtttccaggctaatccagttctcttgacgcccgatccgatcgagctccgtgtttatttcagcctaatcgtagtattcccctaaaatttcctcattagggggttcgcaagattgttggtcgacaggttcacttatgctcgatcgcttacttttagtcgattcatgctgcgtactattgttgccccccgtggttttatcttttctcgtgtgaaatccagtagatatagtagatatcgtagcattaggttttaattcaatcgattgattattgtatcatcaaaattgagaagttcgaatcatgcctatcatgctgcctcaaccgaaatcctgtatattgaagtttcaattcaattgattgatcattcattagattcaaccaaaatctagaaggttagatgacgcatgtcatgctgcctgcgtagtttacctttgatctgtttatgattaccttatcagtaggatatttgtgattttgggaagtagcactaactgattcatgctgacatgatgttccctttcagattatactgttgagtcctatctaattgatgctttgtatgctatatgaatacgtcatggtaaattagcagttaattagcatattagcaattgggcgtacctcatcaggattgctcttgtagatgtgtgtggtgatgtttcttgttcaattcatgttctgctttaaaagtatgtgttctctgtttgttaattaagattcatggttataatgatttggacctaattaatcagggttgcccttttagatgcgtggttacttgttgagttcatttttttcctgctatagttgtatgcgtttgttcattcatggttagatttgatttgtttcttctctattccatgccttccatatacttcaattgtagcttaacatgagatttctgtatatgcaggtcgaccgccggggatccacacgacaccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacatacctcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctcaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgggctccggcgagggtcgcggttccctcctgacctgcggcgacgtggaggaaaaccccggtccgcccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcacc

SEQ ID NO: 115 - DNA, 9361 bp, Artificial
  PHP88194 T-DNA
caaacaaacatacacagcgatttattcacacgaacccgaattacaacggtatatatcctgtcagccaacaccaaaacatcaaaaaaatcgggatcaggatcaggatctgcggccgcatcctgcaggtttaaacggccggccttcactagctagctgctaagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaatcgagctagttaccctatgaggtgacatgaagcgctcacggttactatgacggttagcttcacgactgttggtggcagtagcgtacgacttagctatagttccggacttacctaactgactagagtcacacttagctgaccctagtcacttaggcgcgccaagcttggatctcctgcaggatctggccggccggatgggcggatctcgtacctcaactttgtatagaaaagttgggccgaattcgagctcggtacggccagaatggcccggaccgggttaccgaattcgagctcggtaccctgggatccgatatcgatgggccgcatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccggcggccctggccgaagcttggtcacccggtccgggcctagaaggccagcttcaagtttgtacaaaaaagcaggctggcgccggaaccaattcagtcgagtgcggccgccagtgtgatggatatctcgacccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattctagtggccggcccagctgatatctagacccagctttcttgtacaaagtggcccggggcggccgaagctggccttctaggcccggaccgggtgaccaagcttggcgcgcccagggcccatcgatatcggtacctacgcgttcgaatatccatggatccgaattccgcggccgcttggtaacccggtccgggccattctggccgatccgttaacgcccgggcaactttattatacaaagttgatggtacggatccgtcgacggcgcgccgcggacctgaattccagcacactggcggccgttactagtaacggccgccagtgtgctggaattcgcccttcccaagctttgctctagatcaaactcacatccaaacataacatggatatcttccttaccaatcatactaattattttgggttaaatattaatcattatttttaagatattaattaataagtgactagggtcacgtgaccctagtcacttatgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccatttacaattgaatatatcctgccattttacacctcgatatatcctgccacaaattccatgtacacagtacattaaaaacgtccgcaatgtgttattaagttgtctaagcgtcaatttgtttacaccacaatatatcctgcca

SEQ ID NO: 116 - DNA, 5489 bp, Artificial
  PHP90094 T-DNA
caaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttaccagagctggtcaccttcttcatcgctaagaagacactcagtagtccggaccgatatcgctatcaactttgtatagaaaagttgggccagaatggcccggaccgggttaccaagcggccgcgaattccagaagaccaaagggcaattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacccatggaaactcaacaacaacaagcagatattcaagattttgggaacaaaaacagtaacacctatgcatgcaggcaaagcagtactaggtggacacccacaagtgatcagatcagaatactgaaagagctctactacaacaatggaatcagatcaccaactgctgatcagattcagagaatcgctgctcaactcagacagtacggcaagattgaaggcaagaacgtgttttattggtttcagaaccataaagctcgtgaacgccagaagaaacggttcactcctactgctcctccaccaccgtctcacttctccgatcatattaaccaccatcttcccaacgctgcccccatgcagattccgtctcaccaccaccactaccaccatcaagaaccaccacatgtctatgctcaccctcacaaactctacaccactcatcacattggggttggttcttcttcacaaggagtgatgggtgtagggtgtggctatggatctgttgctatggagaagagtttcaggaagtgttcaatatcaccaccgggagagagtaaggccacaggaggaattggccggaatatcggttcaagatcacggataagtgtcgattcgtgttccttcttcgacacaattaagccaaagacatatgagatgtttgagaatcatgatcaagatgaagaacaaggagagccttcaactgagatcgaaacacttccattattcccgattcacgacggcaaccatcatgatttcttcggcatgaggacggcaaatctgcaattggagcaaggcactggaggttactacactggaggaagctggtatcggtctgatgagagggcgtctcttgagctcagtctcaactcatatggttattataactaattcgaactggccaggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggctcggcgttaggcttttagtccgctaggtggctagaccgaggttaggacgctagttcactaggggcctagtggtgttttaaggatgggcaagtttgtacaaaaaagcaggctccggccagaatctcactgactagctaaacagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattagcttggcgcgccggtcacccggtccgggcctagaaggccacccgggcaactttattatacaaagttgatagatatcggtccgacggccagaatggccatctggattcagcaggcctagaaggccatttagtcctagcgatcgcgctgacaagcggtatttaaatcatcattctaggcgcgccacttacgcttgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgcca

SEQ ID NO: 117 - DNA, 9361 bp, Artificial; identical to SEQ ID NO: 115
  PHP88193 T-DNA

SEQ ID NO: 118 - DNA, 11670 bp, Artificial
  PHP0001 T-DNA+
aattacaacggtatatatcctgtcagccaacaccaaaacatcaaaaaaatcgggatcaggatcaggatctgcggccgcatcctgcaggtttaaacggccggccttcactagctagctgctaagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaatcgagctagttaccctatgaggtgacatgaagcgctcacggttactatgacggttagcttcacgactgttggtggcagtagcgtacgacttagctatagttccggacttacctaactgactagagtcacacttagctgaccctagtcacttaggcgcgccaagcttggatctcctgcaggatctggccggccggatgggcggatctcgtacctcaactttgtatagaaaagttgggccgaattcgagctcggtacggccagaatggcccggaccgggttaccgaattcgagctcggtaccctgggatccgatatcgatgggccgcatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccggcggccctggccgaagcttggtcacccggtccgggcctagaaggccagcttcaagtttgtacaaaaaagcaggctggcgccggaaccaattcagtcgagtgcggccgccagtgtgatggatatctcgacccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattctagtggccggcccagctgatatctagacccagctttcttgtacaaagtggcccggggcggccgaagctggccttctaggcccggaccgggtgaccaagcttggcgcgcccagggcccatcgatatcggtacctacgcgttcgaatatccatggatccgaattccgcggccgcttggtaacccggtccgggccattctggccgatccgttaacgcccgggcaactttattatacaaagttgatggtacggatccgtcgacggcgcgccgcggacctgaattccagcacactggcggccgttactagtaacggccgccagtgtgctggaattcgcccttcccaagctttgctctagatcaaactcacatccaaacataacatggatatcttccttaccaatcatactaattattttgggttaaatattaatcattatttttaagatattaattaataagtgactagggtcacgtgaccctagtcacttatgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccatttacaattgaatatatcctgccacactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccacagaagaccaaagggcaattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacccatggaaactcaacaacaacaagcagatattcaagattttgggaacaaaaacagtaacacctatgcatgcaggcaaagcagtactaggtggacacccacaagtgatcagatcagaatactgaaagagctctactacaacaatggaatcagatcaccaactgctgatcagattcagagaatcgctgctcaactcagacagtacggcaagattgaaggcaagaacgtgttttattggtttcagaaccataaagctcgtgaacgccagaagaaacggttcactcctactgctcctccaccaccgtctcacttctccgatcatattaaccaccatcttcccaacgctgcccccatgcagattccgtctcaccaccaccactaccaccatcaagaaccaccacatgtctatgctcaccctcacaaactctacaccactcatcacattggggttggttcttcttcacaaggagtgatgggtgtagggtgtggctatggatctgttgctatggagaagagtttcaggaagtgttcaatatcaccaccgggagagagtaaggccacaggaggaattggccggaatatcggttcaagatcacggataagtgtcgattcgtgttccttcttcgacacaattaagccaaagacatatgagatgtttgagaatcatgatcaagatgaagaacaaggagagccttcaactgagatcgaaacacttccattattcccgattcacgacggcaaccatcatgatttcttcggcatgaggacggcaaatctgcaattggagcaaggcactggaggttactacactggaggaagctggtatcggtctgatgagagggcgtctcttgagctcagtctcaactcatatggttattataactaattcgaactggccaggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggctcggcgttaggcttttagtccgctaggtggctagaccgaggttaggacgctagttcactaggggcctagtggtgttttaag

SEQ ID NO: 119 - DNA, 10442 bp, Artificial
  PHP80728 T-DNA
aattacaacggtatatatcctgtcagccaacaccaaaacatcaaaaaaatcgggatcaggatcaggatctgcggccgcatcctgcaggtttaaacggccggccttcactagctagctgctaagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaatcgagctagttaccctatgaggtgacatgaagcgctcacggttactatgacggttagcttcacgactgttggtggcagtagcgtacgacttagctatagttccggacttacctaactgactagagtcacacttagctgaccctagtcacttaggcgcgccgtcgacggatccgtaccatcaactttgtataataaagttgcccggacctctagatatcggatcccggggttaaccttcagcttagaaatgatgtgttttctacacttttctcttcttttttttcttttcatctcacatgaatcaaaaagagaaagcttaattacattaaaggttgatgtgatatttactttctaaatatttgctagaagaaattataatgataacattaaattaagttatagtcatttctatttcggttgtctcccactttctgctatgcttttacaacaacagttcaagatttggaatcgttttctttctccaccaatcgtagtaatacttctttttgtgtttgttgaaattttgcaagattctctcttcctctggttaatacacataacttacttggtaagcttggctgcattttcttttcaagcttttaatcaaagactcactagaaattgcaaaggcaaacataaaattatgtgatcaaactcctactgtgagtttttggttacaaacaaaagttaaaaacaaaagcttgatatttaaaagataaactcaacacatatgcatttgactggcgcacagaagacaattcaagacttgggaaaacagtgagccatcaaaatcgtcagataattcagggaatatattgaatgtggagatgtggtaatcacactattgcacacaaagagtggcaaacaagcggcgcccttggtttggtatagtaagagacaattgttttggactgtttgtgttgccatattcacaaaaatactattgagctatgtatgttaaacattatggtcaatgagtagtagtgaacattcaagtttttttttttttccacttcaagtttttcatcttattattatttttcgttgtgatgcagtagtacggcccatcttcaccagtagtatatcaaagccgaaacagatgacaaattgtttaacatgcacttggattattattgagagttgaaatacaaaggcccgttacaagcccaaacgaaggtacataaaagaaaagcagaaaatgaaaacgaaatcgatagggataagtttttccaactgacggaaacacaaactacaccaggtgaaatagatcacctcccaagtgcatgagacacgaaccaaccacttatcatcagatcacaaaagagctcaaagatctagcgatcgcctaattcagtttgtggccaagctttgatggcaagtcgcaatatctagcgacggccacctcgtgctgctccacataagtctccttgtcggcctcttttatgcgctcgagtctatggtccacgtaatacacgccgggcattttcaagtttttggcaggctttttggagcggtaggtggtcttgaagttacagatgagatggcctccgccgacaagcttcaaggccatgtcggatctaccttcaagaccaccgtcggctgggtaaagcatttcagtattggcttcccagccgagagtcttcttctgcatcacgggaccgtttgatgggaagttcacgccgcggatcttgacgttgtagatcaagcagccgtcttgaagactagtgtcttgggtggcggtcaagactcctccgtcttcgtaggtggtcactctctcccaggtgaatccctctgggaatgactgtttgaagaagtctgggatgccctgggtgtggttgatgaaggttctactcccgtacatgaaggaggtggctagtatgtcgaaggcgaatgggagtggacctccttcgaccaccttgattctcatagtctgggttccctcatagggcttgccctcaccctcagaggtacacttgaagtggtgattattcacggtgccctccatgtataacttcatgtgcatgttctctttaatgagctcctcccccttggacaccatggctgtagagtcaacaatcacaagataaatcagaatcaaaatccatcacgtaatttcaagaagcaatttcgtgaaaaaaaatcctaatctatggccacagaatcaacaaataaggtagttgctaaaggacctgagcaatatctcttgaaataccatacagaatcaacgaataaggcttttatcaacggatctgaacaatttcttgaaaaacgactgaagtatcaacaaataaggctgttgtttaacggatctgaagtagttcatgaaaaaaaccttaatctacgactacagaatcaacaattaaggcttgttgtaaacggatctgaaaatctttatgaaaaaaactctaattagacctaatttacggttataaaatcatcaattaaggacgttcttgcattaataaaagctgaatcttctgattatgaaaatttataatcgatgaaacgatagaaaacacaatcaaatcaacatcatgctgatgtagaacaaacaataaagaagaagaaaaaaaaacggaagaaatctacgaaccttgaaaggagaggtagggaactgcgcaaagagaatgaactaatttgattgcaattgaagtgcgattagggtcgaggggtgtgggggcattttatagcatatgcggtggaaccgttctccaatcatattgtgacgcgtgcccatgtatggtgtgacttggtgtttatgacacagatgatatttcggggagtccttcgtagttgacggtttcgtaatcttgacggagtcagagatgtaccttcaccgcttcacgcttggctttatccgttaccacggcgttattaaattgggcccgcacccgttgcaagttaggaccacagtgtccattacctgaacggtcggctgctaccagtattttacattattaaaatctatggaaaagctgtcacgctagatttttttttttttttttatggataagaaaagactaataggaaagctttcttactccactaaagtctttaataattattttttcaattttcaaataaaatcataatcatcccactaaattctttctcatttgtttttcactttgtaagatattcttccgtagatttttataagtaattctttaagatacatagcataataaattgtatacttttagttacagtctatataaaattagtcatttaaaaaatatagccttaatgatttttttaaaatgaagttatttttttctaatttttctttcttatttattatcgaatgattttttctactaatcgtttagggaagagttttatttttctaatgacgagatgtgttaaatgatgcaacttgaaggcgacatattttttaccaataaaataaaactaaaagatagcttgttgacaaaaacaataattgatgttaaagaaaacgtaagggcaatgggtatcatctaattgttggacaagttgtcttctaaggctaggtaagcttttgttttttattagctgaaatatttatttaattgttctataaataaattttttaaaatgatttttaatgtttttaaatattatttaaaataatttttttaaaattttaacattttagtttttaattattttttatcttacttaaattaattataatttattattttctaccattttatactttccaattaattttatcgaagcattaataccatctggtattttgtcactgcttcgtatgattgtttattaaattttagcttctttcacattggagatgctgggcggtgtgagttacagcatggtgtgaagttaaggtggtttgattatggaacccgaaggtgttggtgcaaggtggataaaattgcttgccaggagatacataaaatgatttacaaaatgaaataaagaataaataaatagtcaagttcaaatttaaatcaaggattagaattatttttccgtacatgatgtaaccgcaatcaccccctgctgaatccagatggccattctggccgaatttaagtgactagggtcaccctgctgaatccagatggccattctggccgaatttaagtgactagggtcacgtgaccctagtcacttaccggattctggccgtaccgagctcgaattcggcccaacttttctatacaaagttgaggtacgagatccgcccatccggccggccagatcctgcaggagatccaagcttggcgcgccgcggacctgaattccagcacactggcggccgttactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccaccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgaggtacaaattaattaataagtgactagggtcacgtgaccctagtcacttatgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccatttacaattgaatatatcctgccattttacacctcgatatatcctgccacaaattccatgtacacagtacattaaaaacgtccgcaatgtgttattaagttgtctaagcgtcaatttgtttacaccacaatatatcctgcca

SEQ ID NO: 120 - DNA, 12799 bp, Artificial
  PHP81718 T-DNA+
aattacaacggtatatatcctgtcagccaacaccaaaacaggcgcgcctggatcaggatcaggatctgcggccgcatcctgcaggtcgactctagaggatcctcatcgctatcaactttgtatagaaaagttgggccgaattcgagctcggtacggccagaatccggtaagtgactagggtcacgtgaccctagtcacttaaattcggccagaatggccatctggattcagcaggcctagaaggcccggaccgattaaactttaattcggtccgggttacctcgagtaatactagatatctcgacccgggtacaagaaagctgggtgcccggccgcagatttaggtgacactatagaatatgcatcactagtaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataaccatgccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcagccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagtgggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgggcccggccgaagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatccggtaagtgactagggtcacgtgaccctagtcacttaaattcggccagaatggccatctggattcagcagggggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggtgtccaagggggaggagctcattaaagagaacatgcacatgaagttatacatggagggcaccgtgaataatcaccacttcaagtgtacctctgagggtgagggcaagccctatgagggaacccagactatgagaatcaaggtggtcgaaggaggtccactcccattcgccttcgacatactagccacctccttcatgtacgggagtagaaccttcatcaaccacacccagggcatcccagacttcttcaaacagtcattcccagagggattcacctgggagagagtgaccacctacgaagacggaggagtcttgaccgccacccaagacactagtcttcaagacggctgcttgatctacaacgtcaagatccgcggcgtgaacttcccatcaaacggtcccgtgatgcagaagaagactctcggctgggaagccaatactgaaatgctttacccagccgacggtggtcttgaaggtagatccgacatggccttgaagcttgtcggcggaggccatctcatctgtaacttcaagaccacctaccgctccaaaaagcctgccaaaaacttgaaaatgcccggcgtgtattacgtggaccatagactcgagcgcataaaagaggccgacaaggagacttatgtggagcagcacgaggtggccgtcgctagatattgcgacttgccatcaaagcttggccacaaactgaattaggcgatcgctagatctttgagctcttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgttaaacaatttgtcatctgtttcggctttgatatactactggtgaagatgggccgtactactgcatcacaacgaaaaataataataagatgaaaaacttgaagtggaaaaaaaaaaaaacttgaatgttcactactactcattgaccataatgtttaacatacatagctcaatagtatttttgtgaatatggcaacacaaacagtccaaaacaattgtctcttactataccaaaccaagggcgccgcttgtttgccactctttgtgtgcaatagtgtgattaccacatctccacattcaatatattccctgaattatctgacgattttgatggctcactgttttcccaagtcttgaattgtcttctgtgcgccagtcaaatgcatatgtgttgagtttatcttttaaatatcaagcttttgtttttaacttttgtttgtaaccaaaaactcacagtaggagtttgatcacataattttatgtttgcctttgcaatttctagtgagtctttgattaaaagcttgaaaagaaaatgcagccaagcttaccaagtaagttatgtgtattaaccagaggaagagagaatcttgcaaaatttcaacaaacacaaaaagaagtattactacgattggtggagaaagaaaacgattccaaatcttgaactgttgttgtaaaagcatagcagaaagtgggagacaaccgaaatagaaatgactataacttaatttaatgttatcattataatttcttctagcaaatatttagaaagtaaatatcacatcaacctttaatgtaattaagctttctctttttgattcatgtgagatgaaaagaaaaaaaagaagagaaaagtgtagaaaacacatcatttctaagctgaaggttaaccccgggcagatctaggcgcgcccgaagttcctattccgaagttcctattctacatagagtataggaacttccgatggccgccaccgcggtggagatccatcacactggcggccgcgcatgctgacttaatcagctaacgccactcgactctagaggtccgggcaactttattatacaaagttgatagattgggcgcgccgaattcatttacaattgaatatatcctgccattttacacctcgatatatcctgccacaaattccatgtacacagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagagggccgcccgggcaatcaaattatatatgtaaagcaattacagtttatcaaactttatttatggaaataatttattatcacatttattttggtttataaattttaaattaaaatatcacctaaataaaaataatttttaacatgacttattgtcctaaataaattatttccgtaaattaaataaaatgaagtttttttctttcaaagaatctaaatggtcataatgagaattctctaaaaaaatacataatgagaataattatggaatttatttattaataaaaattaatagcattttgatagacaattaataaaattttaaaaataaccatatagaaataataatttttttactatcggttccaattaaaataatgataaaaaataaaatagattattaattgatattgatatgaaatttaaataaagaatataatcatatattttattgatatatgatatgatatagattaattgatattgattttgatatggaatttaaaaataatataataattgtttttatttattaatacgtgtaatcaaataattctcactttttgaatcaatcagtgtacttaaagataatatcagttgaatattttttatccttttacgtgtgctgtgagacattatcatcaattgtgttgtatatgatatatagatatagatatataaatatatagattgagtgatataatatatttaaaatataaattatatatatgttttaatatatttttgcatatatatatatatttgtaaaaactagaagtattttttcatgagataattattatcgagttgaataagtctattatttgtgagagccaaccatatttatatatgtgattaaattttatctttgtgaaattaaaaataataaaaaataccttaaaatcataataatagaaaaacttatatttataatttaccattatacttaaaaaaaattaaataaatattataaatataaatactatcgagtaatggccgcgctagggtttttgagaaaaaatcttcccacgcactcaactgcactgtacggcgtcgttttcacagccgcataatagaagccgcgttccccaacccttcctcacaacattctcggaccctccagcaccgtcacccaaacaaatatccacgcggtagtaggcgcgtgaaacaaactctaatccgaactacgagacgtgagaagcacgcgctttagcgagcgtttcaattgtcgctacgaaagcagagaaggatacaaacggaactagggtaaattagtaagggtaatttcgtaaacagaagaaaagagttgtagctataaataaaccctctaaccctcgtcgcattacttctcttcacacctttgttcactcttcttctcttgcggctagggttttagcgcagcttcttctaggttcgttatctaccaccgttctatggattttattccttctattcgtgtttattctattggtttatgttgcttgcaatatgttttttctgaatctgtcgtcgttgtcttcaattttatccatgtttcagagatcaattttgtttgtgtagtatgtgcttattcttcttcttttcgttcgagttgttaataacggtgctatggtgttttcaaaagtgttttttttattacttttgatttaaagtttttttggtaaggcttttatttgcttgttatattcaaatctttggatccagatcttatataagtttttggttcaagaaagtttttggttactgatgaatagatctattaactgttactttaatcgattcaagctaaagttttttggttactgatgaatagatctattatctgttacttttaatcggttcaagctcaagttttttggttactgatgaatagatctatatacgtcacagtgtgctaaacatgcccttgttttatctcgatcttatgtatgggagtgccataaattttgttatgtctatttttttatctgttggaatcatactgagtttgatgcgttacgattgagcatacctatttttgggcttgttgtatggtgggtatttagatcttaatctttttatgcttatgaaaggttttgtaatgacaaaggtcttaatgttgttaaacttttatttttactttatatggtgtgttgatgtgttatggttttgacaactttttttttttctggatttttgcagatttaaggaagccccatggagcctcctcagcaccaacatcaccaccatcaggccgatcaagagtccgggaacaacaacaacaacaagtccggttccggagggtacacttgcagacagacctccaccagatggacacctaccactgagcagatcaagatcctgaaggagttgtactacaacaatgccatccgctcccctactgctgatcagattcagaagatcaccgctcgcctgcgtcaattcggtaagatcgagggtaagaacgtcttctactggttccagaaccacaaggctcgtgagaggcagaagaagcgtttcaacgggactaacatgaccactccttcctcatcacccaattctgttatgatggccgccaacgaccactaccatcctttgcttcatcaccaccacggagttcctatgcaaagacccgcaaactccgtcaacgtgaagttgaaccaggaccatcacctctaccaccacaacaagccctacccctctttcaacaacgggaatctcaaccatgcctcctctggaaccgaatgtggagttgtcaacgcctccaacggctacatgtcttcccacgtgtacggctctatggagcaagattgctccatgaactacaacaacgttggaggcggatgggcaaacatggatcaccactactcctccgctccctacaacttcttcgatagggctaaacctctcttcggcttggagggacaccaagaagaagaggaatgcggaggtgatgcttacttggaacacagaaggactctccctctctttccaatgcacggtgaggaccacatcaacggaggatctggcgctatctggaagtatggacagtccgaggtcagaccatgcgcttccctggaattgagactgaactagattgggacctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacaga

SEQ ID NO: 121 - DNA, 17830 bp, Artificial
  PHP0002 T-DNA+
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtacctagtacccttgtacttttggtttcacctgcatagagaaaacccacaagaatatgacagtctgatttgtcagtctcattctcaagcaacatttctctatccgttactttcatggtgaataacacaatccatcatcaatactttgtgttactcagaaactgaaagttattccgagtcttgcatatctttggacctactcgtttttctaccattattgctgattgttaagctctcgctacttgaatcggcattgttggagtgggaaggttcaaaaaattggagttatgactagttgtctctttctatgtacgatggagaaaatgaataaacaactgagaaaatggctcttgtttagttgatgatgctcttaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgcgctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgaacgagaaacgtaaaatgatataaatatcaatatattaaattagattttgcataaaaaacagactacataatactgtaaaacacaacatatccagtcactatggtcgaccgacagccttccaaatgttcttctcaaacggaatcgtcgtatccagcctactcgctattgtcctcaatgccgtattaaatcataaaaagaaataagaaaaagaggtgcgagcctcttttttgtgtgacaaaataaaaacatctacctattcatatacgctagtgtcatagtcctgaaaatcatctgcatcaagaacaatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatccacgcggcgtttacgccccccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttacggccgccatagtgactggatatgttgtgttttacagtattatgtagtctgttttttatgcaaaatctaatttaatatattgatatttatatcattttacgtttctcgttcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactagcgtggcatttggcaccgccgcacactatgcgagctaggagtgctagtttacagatgaaactatgaaaccaagaaaacacaattgtccgtagctagcgcgtggcgtcgtgtcaagcttcacacagtatcttcgttcttcactataaatcgcgcctgttgttcgtgagacccaccaccgtggataacagtcccctaataataagcgatcaacagcactgctgatggctgaacaccgaggcgccgccgcgcgtaaccatccgccggagcagcccgtcgtgccggcgaacgacgccttccccgaccgcgcccagcagctctgcctcgacgccgggcgcgcgctcgcgatgtgcggcgtgctcgtcgccgtccctcccgcattttacgcgtcgacgtcgcggacgacaccgcacttgccttcgtcggcttcgtcctctggatcatcggtgcgtggctgtgcctcctggcgctcacgcccttggctccacgggcggtgagggcgggcggggccgccgccagcaccttgctgatcaggtgcctgtccctttcatgaactactagcgcccgcgcccgcggccgccgggcacaagagaacacatcgatgttcgctgcgtacgtcagcaataaggcactctttgtcagtagtcgagtgcatatgttgggtgtttgccctgggagatttcaagtgttgtggccattatcccgcaggataaaaaatcggcggcttttggattgatacggaaaataacgatgtttcatgctcgtgttgtgtgtgtgacatcttgtcagccaagtttttaaccgttgctactccccctctgtgggctcagtgtgtggaccggaatacgtcgtacataggccgtagcctaagcccaatatgccgtttttcaggttggcctgtgtgacgacaagcgggtctcaaaagcccatcacgcaactggcctgcaattattggaggagagcgcgtcgagttggttccagaggctgcgtggtggggccggactctgcgacgacctctcgttcgcgtccgatttggttgccgtgagccgtgacgtaacgcctccttccgttcctccctatataagttccacccccgggtccggtttccccaagccccagtgacccccgatcccgatcgcgaaatctccgcacccgccggcaagggaccgaagcaagcctctctcccgaccgtcgcatcaaggtacgcgtccgctcgatctgtcctcttccttctcgatttgacttgctgtggtgcccgatcacgggatcagaatcgcaccagtgtagatttcgcatgttctaagatgtgttagtttccaggctaatccagttctcttgacgcccgatccgatcgagctccgtgtttatttcagcctaatcgtagtattcccctaaaatttcctcattagggggttcgcaagattgttggtcgacaggttcacttatgctcgatcgcttacttttagtcgattcatgctgcgtactattgttgccccccgtggttttatcttttctcgtgtgaaatccagtagatatagtagatatcgtagcattaggttttaattcaatcgattgattattgtatcatcaaaattgagaagttcgaatcatgcctatcatgctgcctcaaccgaaatcctgtatattgaagtttcaattcaattgattgatcattcattagattcaaccaaaatctagaaggttagatgacgcatgtcatgctgcctgcgtagtttacctttgatctgtttatgattaccttatcagtaggatatttgtgattttgggaagtagcactaactgattcatgctgacatgatgttccctttcagattatactgttgagtcctatctaattgatgctttgtatgctatatgaatacgtcatggtaaattagcagttaattagcatattagcaattgggcgtacctcatcaggattgctcttgtagatgtgtgtggtgatgtttcttgttcaattcatgttctgctttaaaagtatgtgttctctgtttgttaattaagattcatggttataatgatttggacctaattaatcagggttgcccttttagatgcgtggttacttgttgagttcatttttttcctgctatagttgtatgcgtttgttcattcatggttagatttgatttgtttcttctctattccatgccttccatatacttcaattgtagcttaacatgagatttctgtatatgcaggtcgaccgccggggatccacacgacaccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacatacctcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctcaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcgggccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacatggcctcttcatctgcacccaggttccgtgtctattccaagtacctctttctaacatatcctgaatgtacccttgagccacagtacgccttggattcacttcgcactctcttgaacaaatatgagcccctctacatcgctgctgttagagagctccacgaagatggatcaccacatctgcacgttctcgtgcagaacaagcttcgtgcttccatcaccaatcccaatgccttaaacctccgtatggatacatctccattctccatattccatccaaatatacaagctgccaaagactgcaaccaagttcgtgattacatcacgaaggaggttgactccgatgtaaacacagctgagtggggaacattcgtggctgtttcaactccaggtcgtaaagaccgtgatgcggatatgaaacagatcattgaatctagttcctctcgcgaggaattcctcagcatggtttgcaatcgttttccgtttgaatggtctatccgtctcaaagacttcgagtacacggcacgccatctatttcctgacccagttgccacttacacacctgagtttccaaccgaatcactcatttgccatgagaccattgaaagctggaaaaatgaacatctctactctctgtccctcgagagctacatcctgtgcaccagcacccctgccgaccaggcccagtccgacctcgaatggatggacgactacagccgtagtcaccggggaggcataagtccatctacatctgcgggccaaccagaacaggaaagacttcctgggcaaggtctctagtgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcacc

SEQ ID NO: 122 - DNA, 17680 bp, Artificial
  PHP0003 T-DNA+
  misc_feature (16754)..(16754): n is a, c, g, or t
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtacctagtacccttgtacttttggtttcacctgcatagagaaaacccacaagaatatgacagtctgatttgtcagtctcattctcaagcaacatttctctatccgttactttcatggtgaataacacaatccatcatcaatactttgtgttactcagaaactgaaagttattccgagtcttgcatatctttggacctactcgtttttctaccattattgctgattgttaagctctcgctacttgaatcggcattgttggagtgggaaggttcaaaaaattggagttatgactagttgtctctttctatgtacgatggagaaaatgaataaacaactgagaaaatggctcttgtttagttgatgatgctcttaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgcgctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgaacgagaaacgtaaaatgatataaatatcaatatattaaattagattttgcataaaaaacagactacataatactgtaaaacacaacatatccagtcactatggtcgaccgacagccttccaaatgttcttctcaaacggaatcgtcgtatccagcctactcgctattgtcctcaatgccgtattaaatcataaaaagaaataagaaaaagaggtgcgagcctcttttttgtgtgacaaaataaaaacatctacctattcatatacgctagtgtcatagtcctgaaaatcatctgcatcaagaacaatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatccacgcggcgtttacgccccccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttacggccgccatagtgactggatatgttgtgttttacagtattatgtagtctgttttttatgcaaaatctaatttaatatattgatatttatatcattttacgtttctcgttcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactagcgtggcatttggcaccgccgcacactatgcgagctaggagtgctagtttacagatgaaactatgaaaccaagaaaacacaattgtccgtagctagcgcgtggcgtcgtgtcaagcttcacacagtatcttcgttcttcactataaatcgcgcctgttgttcgtgagacccaccaccgtggataacagtcccctaataataagcgatcaacagcactgctgatggctgaacaccgaggcgccgccgcgcgtaaccatccgccggagcagcccgtcgtgccggcgaacgacgccttccccgaccgcgcccagcagctctgcctcgacgccgggcgcgcgctcgcgatgtgcggcgtgctcgtcgccgtccctcccgcattttacgcgtcgacgtcgcggacgacaccgcacttgccttcgtcggcttcgtcctctggatcatcggtgcgtggctgtgcctcctggcgctcacgcccttggctccacgggcggtgagggcgggcggggccgccgccagcaccttgctgatcaggtgcctgtccctttcatgaactactagcgcccgcgcccgcggccgccgggcacaagagaacacatcgatgttcgctgcgtacgtcagcaataaggcactctttgtcagtagtcgagtgcatatgttgggtgtttgccctgggagatttcaagtgttgtggccattatcccgcaggataaaaaatcggcggcttttggattgatacggaaaataacgatgtttcatgctcgtgttgtgtgtgtgacatcttgtcagccaagtttttaaccgttgctactccccctctgtgggctcagtgtgtggaccggaatacgtcgtacataggccgtagcctaagcccaatatgccgtttttcaggttggcctgtgtgacgacaagcgggtctcaaaagcccatcacgcaactggcctgcaattattggaggagagcgcgtcgagttggttccagaggctgcgtggtggggccggactctgcgacgacctctcgttcgcgtccgatttggttgccgtgagccgtgacgtaacgcctccttccgttcctccctatataagttccacccccgggtccggtttccccaagccccagtgacccccgatcccgatcgcgaaatctccgcacccgccggcaagggaccgaagcaagcctctctcccgaccgtcgcatcaaggtacgcgtccgctcgatctgtcctcttccttctcgatttgacttgctgtggtgcccgatcacgggatcagaatcgcaccagtgtagatttcgcatgttctaagatgtgttagtttccaggctaatccagttctcttgacgcccgatccgatcgagctccgtgtttatttcagcctaatcgtagtattcccctaaaatttcctcattagggggttcgcaagattgttggtcgacaggttcacttatgctcgatcgcttacttttagtcgattcatgctgcgtactattgttgccccccgtggttttatcttttctcgtgtgaaatccagtagatatagtagatatcgtagcattaggttttaattcaatcgattgattattgtatcatcaaaattgagaagttcgaatcatgcctatcatgctgcctcaaccgaaatcctgtatattgaagtttcaattcaattgattgatcattcattagattcaaccaaaatctagaaggttagatgacgcatgtcatgctgcctgcgtagtttacctttgatctgtttatgattaccttatcagtaggatatttgtgattttgggaagtagcactaactgattcatgctgacatgatgttccctttcagattatactgttgagtcctatctaattgatgctttgtatgctatatgaatacgtcatggtaaattagcagttaattagcatattagcaattgggcgtacctcatcaggattgctcttgtagatgtgtgtggtgatgtttcttgttcaattcatgttctgctttaaaagtatgtgttctctgtttgttaattaagattcatggttataatgatttggacctaattaatcagggttgcccttttagatgcgtggttacttgttgagttcatttttttcctgctatagttgtatgcgtttgttcattcatggttagatttgatttgtttcttctctattccatgccttccatatacttcaattgtagcttaacatgagatttctgtatatgcaggtcgaccgccggggatccacacgacaccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacatacctcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctcaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcgggccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacggatccgtcccccagatttgctaggacaccgccgtacccacaccccggatcagttaatatcgtagacataatggccctccctgccatctccacaaccaagcactcccatcatcatgcatgcagcaggctgtgctgtggacctgatcgagtttcaattgatccaagcaagcaagagggatgggagtccttggttgtggaaattgcagagagagaccagtcgttgatcggtcggagatctccccgaatcgatctcgatcggccggaattttgggggccggccgggaggtggatgatggggggtgattaccatctaggcggcgccgtgttggatgatgtaccaacatatcactataggctactttgggaacctcagatccccttcgggattggaggaaattgagatggaaatgaactaatttcttctctaacccccttcaatcacgaaggggattcgagtttccaaactagccctatatatatcagagctagggagggatattgctgcaacatgcatcacgaggtacagatatataattagggttctgctgcaatgttttgactatagatcgttagtgatctgctgtaattaataataatggngatctcgaagcaattctaaacatcatagtagcaggcccaggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcacc

SEQ ID NO: 123 - DNA, 6270 bp, Artificial
  PHP5096
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaacaatgccccagttcgacatcctctgcaagaccccccccaaggtgctcgtgaggcagttcgtggagaggttcgagaggccctccggcgagaagatcgccctctgcgccgccgagctcacctacctctgctggatgatcacccacaacggcaccgccattaagagggccaccttcatgtcatacaacaccatcatctccaactccctctccttcgacatcgtgaacaagtccctccagttcaaatacaagacccagaaggccaccatcctcgaggcctccctcaagaagctcatccccgcctgggagttcaccatcatcccctactacggccagaagcaccagtccgacatcaccgacatcgtgtcatccctccagcttcagttcgagtcctccgaggaggctgacaagggcaactcccactccaagaagatgctgaaggccctcctctccgagggcgagtccatctgggagatcaccgagaagatcctcaactccttcgagtacacctccaggttcactaagaccaagaccctctaccagttcctcttcctcgccaccttcatcaactgcggcaggttctcagacatcaagaacgtggaccccaagtccttcaagctcgtgcagaacaagtacctcggcgtgatcatccagtgcctcgtgaccgagaccaagacctccgtgtccaggcacatctacttcttctccgctcgcggcaggatcgaccccctcgtgtacctcgacgagttcctcaggaactcagagcccgtgctcaagagggtgaacaggaccggcaactcctcctccaacaagcaggagtaccagctcctcaaggacaacctcgtgaggtcctacaacaaggccctcaagaagaacgccccctactccatcttcgccatcaagaacggccccaagtcccacatcggtaggcacctcatgacctccttcctctcaatgaagggcctcaccgagctcaccaacgtggtgggcaactggtccgacaagagggcctccgccgtggccaggaccacctacacccaccagatcaccgccatccccgaccactacttcgccctcgtgtcaaggtactacgcctacgaccccatctccaaggagatgatcgccctcaaggacgagactaaccccatcgaggagtggcagcacatcgagcagctcaagggctccgccgagggctccatcaggtaccccgcctggaacggcatcatctcccaggaggtgctcgactacctctcctcctacatcaacaggaggatctgagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggccgcgatctggggaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 124 - DNA, 7122 bp, Artificial
  PHP89030
cccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccggccagaatggcccggaccgggttacgttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcacccgtacgcgtgcgatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaaattccggactagtggcgcgcctcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccaccggtgcctaggcccgggcacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaagg

SEQ ID NO: 125 - DNA, 6805 bp, Artificial
  PHP89179
cccagtcttccgactgagcctttcgttttatttgatgcctggcagttccctactctcgcgttcatggagctccaaataatgattttattttgactgatagtgacctgttcgttgcaacaaattgataagcaatgcttttttataatgccaactttgtatagaaaagttgggccgagctcggtacggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcgggaatttaaatgctcggcgttaggcttttagtccgctaggtggctagaccgaggttaggacgctagttcactaggggcctagtggtgttttaagacgtcacggtcacctgaagaaactatgtgctgtagtatagccgctgcccgctggctagctagctagttgagtcatttagcggcgatgattgagtaataatgtgtcacgcatcaccatgcatgggtggcagtgtcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtcaacggaagcgagtcgacctcgagggggggccccggccgaagcttcggccggggcccatcgataacgagtatcggtccccattgacacatctactcctaacgctaacaacattcttcacttctagtgtatggcatcgacaattggtactttaatcttgggtcttcacttttacaactaaacaacccaaatataaatattatttgagtgggtttggtgttcatcagaacattcccatctttggtaatgctacctagcataaaagtgagctatcacgttgggcagcccattccatgcaatttttaccttcctcaaaaaaaatctttgatatatttatggtataataatttaaacttcacattgatcataattttttcagcaaataagttccataatttggtgtttgcaatatcgaaattgttactcatagggtccagttgatttaatgacattagtgttgttaagttcacatgcttcaaagaattctacatgtctacaatgctgcatttgtctgtaaaatttgggttcttgtaaaaaatacatgtgttgaatatttaccaaaaaaatataatgcgatatgactttgtgtgagcatgtttggacacagttacaagtttacttctaaacttatattatgttttgcttcgtgcaagtacaagtgatttgaatatccaaggccaaagcatgtgtccatcactatatcaaatcaacataccatatatgtatatactcaacaaaaagcacaaataatcacatctatgttataaacacacccccacacaaccaaacattaacattcaataggttgtgctaggacatcattgggatgatgaagtaatattgtattatctatgtattgaccaagcatgagtttaaaattacgatttgatgttttcagttatttatatgatgaacatagttcagaaatatatcgagataaatctcaatcaatatattgattatttctaggaaacacatgccggtatgagggcaccattgtcgagtacatcttaagtgagttaacggatcctctagagtcgacctgcaggcatgcccgcggatatcgatgggccccggccgaagcttcaagtttgtacaaaaaagttgaacgagaaacgtaaaatgatataaatatcaatatattaaattagattttgcataaaaaacagactacataatactgtaaaacacaacatatgcagtcactatgaaccaactacttagatggtattagtgacctgtagaattcgagctctagagctgcagggcggccgcgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaagg

SEQ ID NO: 126 - DNA, 5080 bp, Artificial
  PHP0004
gaagttcctattccgaagttcctattctctagaaagtataggaacttcagatcctagaggatcgatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagatccatgcatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggccagcttggtcacccggtccgggcctagaaggccgatctcccgggcacccagctttcttgtacaaagtggccgttaacggatcggccagaatggcccggaccgggttacccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccaccggtcgccaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagcggcccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgaagctgggcaactttattatacaaagttgatagatcgagcgactaattaactagctgtcccacggcctaactagcacttaatcccctagcctaacctaagagcgctaatctaggctagtggtcacttagggctttaaggctagcgtatacgaagttcctattccgaagttcctattctccagaaagtataggaacttc

SEQ ID NO: 127 - DNA, 13215 bp, Artificial
  PHP0005 T-DNA+
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtacctagtacccttgtacttttggtttcacctgcatagagaaaacccacaagaatatgacagtctgatttgtcagtctcattctcaagcaacatttctctatccgttactttcatggtgaataacacaatccatcatcaatactttgtgttactcagaaactgaaagttattccgagtcttgcatatctttggacctactcgtttttctaccattattgctgattgttaagctctcgctacttgaatcggcattgttggagtgggaaggttcaaaaaattggagttatgactagttgtctctttctatgtacgatggagaaaatgaataaacaactgagaaaatggctcttgtttagttgatgatgctcttaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgcgctatagttccggacttacccttaatagcgtggcatttggcaccgccgcacactatgcgagctaggagtgctagtttacagatgaaactatgaaaccaagaaaacacaattgtccgtagctagcgcgtggcgtcgtgtcaagcttcacacagtatcttcgttcttcactataaatcgcgcctgttgttcgtgagacccaccaccgtggataacagtcccctaataataagcgatcaacagcactgctgatggctgaacaccgaggcgccgccgcgcgtaaccatccgccggagcagcccgtcgtgccggcgaacgacgccttccccgaccgcgcccagcagctctgcctcgacgccgggcgcgcgctcgcgatgtgcggcgtgctcgtcgccgtccctcccgcattttacgcgtcgacgtcgcggacgacaccgcacttgccttcgtcggcttcgtcctctggatcatcggtgcgtggctgtgcctcctggcgctcacgcccttggctccacgggcggtgagggcgggcggggccgccgccagcaccttgctgatcaggtgcctgtccctttcatgaactactagcgcccgcgcccgcggccgccgggcacaagagaacacatcgatgttcgctgcgtacgtcagcaataaggcactctttgtcagtagtcgagtgcatatgttgggtgtttgccctgggagatttcaagtgttgtggccattatcccgcaggataaaaaatcggcggcttttggattgatacggaaaataacgatgtttcatgctcgtgttgtgtgtgtgacatcttgtcagccaagtttttaaccgttgctactccccctctgtgggctcagtgtgtggaccggaatacgtcgtacataggccgtagcctaagcccaatatgccgtttttcaggttggcctgtgtgacgacaagcgggtctcaaaagcccatcacgcaactggcctgcaattattggaggagagcgcgtcgagttggttccagaggctgcgtggtggggccggactctgcgacgacctctcgttcgcgtccgatttggttgccgtgagccgtgacgtaacgcctccttccgttcctccctatataagttccacccccgggtccggtttccccaagccccagtgacccccgatcccgatcgcgaaatctccgcacccgccggcaagggaccgaagcaagcctctctcccgaccgtcgcatcaaggtacgcgtccgctcgatctgtcctcttccttctcgatttgacttgctgtggtgcccgatcacgggatcagaatcgcaccagtgtagatttcgcatgttctaagatgtgttagtttccaggctaatccagttctcttgacgcccgatccgatcgagctccgtgtttatttcagcctaatcgtagtattcccctaaaatttcctcattagggggttcgcaagattgttggtcgacaggttcacttatgctcgatcgcttacttttagtcgattcatgctgcgtactattgttgccccccgtggttttatcttttctcgtgtgaaatccagtagatatagtagatatcgtagcattaggttttaattcaatcgattgattattgtatcatcaaaattgagaagttcgaatcatgcctatcatgctgcctcaaccgaaatcctgtatattgaagtttcaattcaattgattgatcattcattagattcaaccaaaatctagaaggttagatgacgcatgtcatgctgcctgcgtagtttacctttgatctgtttatgattaccttatcagtaggatatttgtgattttgggaagtagcactaactgattcatgctgacatgatgttccctttcagattatactgttgagtcctatctaattgatgctttgtatgctatatgaatacgtcatggtaaattagcagttaattagcatattagcaattgggcgtacctcatcaggattgctcttgtagatgtgtgtggtgatgtttcttgttcaattcatgttctgctttaaaagtatgtgttctctgtttgttaattaagattcatggttataatgatttggacctaattaatcagggttgcccttttagatgcgtggttacttgttgagttcatttttttcctgctatagttgtatgcgtttgttcattcatggttagatttgatttgtttcttctctattccatgccttccatatacttcaattgtagcttaacatgagatttctgtatatgcaggtcgaccgccggggatccacacgacaccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacatacctcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgggctccggcgagggtcgcggttccctcctgacctgcggcgacgtggaggaaaaccccggtccgatggcctcttcatctgcacccaggttccgtgtctattccaagtacctctttctaacatatcctgaatgtacccttgagccacagtacgccttggattcacttcgcactctcttgaacaaatatgagcccctctacatcgctgctgttagagagctccacgaagatggatcaccacatctgcacgttctcgtgcagaacaagcttcgtgcttccatcaccaatcccaatgccttaaacctccgtatggatacatctccattctccatattccatccaaatatacaagctgccaaagactgcaaccaagttcgtgattacatcacgaaggaggttgactccgatgtaaacacagctgagtggggaacattcgtggctgtttcaactccaggtcgtaaagaccgtgatgcggatatgaaacagatcattgaatctagttcctctcgcgaggaattcctcagcatggtttgcaatcgttttccgtttgaatggtctatccgtctcaaagacttcgagtacacggcacgccatctatttcctgacccagttgccacttacacacctgagtttccaaccgaatcactcatttgccatgagaccattgaaagctggaaaaatgaacatctctactctctgtccctcgagagctacatcctgtgcaccagcacccctgccgaccaggcccagtccgacctcgaatggatggacgactacagccgtagtcaccggggaggcataagtccatctacatctgcgggccaaccagaacaggaaagacttcctgggcaaggtctctaggcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggg

SEQ ID NO: 128 - DNA, 6837 bp, Artificial
  PHP38042 T-DNA+
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcccaagctggtacgattgtaatacgactcactatagggcgaattgagcgctgtttaaacgctcttcaactggaagagcggttaccagaggccagaatggccatctcggaccgatatcgctatcaactttgtatagaaaagttgggccgaattcgagctcggtacggccagaatggcccggaccgggttacaattccatggagtcaaaaattcagatcgaggatctaacagaactcgccgtgaagactggcgaacagttcatacagagtcttttacgactcaatgacaagaacccgggctcgaggaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactagactctatcagtgatagagtgtatataagactctatcagtgatagagtgaactctatcagtgatagagttgtacttatttttacaacaattaccaacaacaacaaacaacaaacaacattacaattactatttacaattacagtcgacggatcaagtgcaaaggtccgccttgtttctcctctgtctcttgatctgactaatcttggtttatgattcgttgagtaattttggggaaagcttcgtccacagtttttttttcgatgaacagtgccgcagtggcgctgatcttgtatgctatcctgcaatcgtggtgaacttatttcttttatatccttcactcccatgaaaaggctagtaatctttctcgatgtaacatcgtccagcactgctattaccgtgtggtccatccgacagtctggctgaacacatcatacgatattgagcaaagatcgatctatcttccctgttctttaatgaaagacgtcattttcatcagtatgatctaagaatgttgcaacttgcaaggaggcgtttctttctttgaatttaactaactcgttgagtggccctgtttctcggacgtaaggcctttgctgctccacacatgtccattcgaattttaccgtgtttagcaagggcgaaaagtttgcatcttgatgatttagcttgactatgcgattgctttcctggacccgtgcagctgcggacggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctccgcgccgccggctacaagcacggcggctggcacgacgtcggcttctggcagcgcgacttcgagctgccggccccgccgcgcccggtgcgcccggtgacgcagatctccggtggaggcggcagcggtggcggaggctccggaggcggtggctccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagtcaggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggtcacccggtccgggcctagaaggccagcttcggccgccccgggcaactttattatacaaagttgatagatatcggtccgagcggcctagaaggcctttggtcacctttgtccaccaagatggaactgcggccgctcattaattaagtcaggcgcgcctctagttgaagacacgttcatgtcttcatcgtaagaagacactcagtagtcttcggccagaatggcctaactcaaggccatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgaccagggtaccctgggatccgatatcgatgggccctggccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggccagactcgacaagagcaaggtgatcaacagcgcactggagctgctgaacgaggtcggaatcgaaggcctcacaacccgtaaactcgcccagaagctcggggtagagcagcctacattgtattggcacgtcaagaacaagcgggctttgctagacgccctcgccattgagatgctcgataggcaccatacccacttctgccctttggaaggggaaagctggcaagacttcttgaggaacaacgctaagagcttcagatgtgctttgctcagtcaccgtgatggagccaaggtccacctaggtacacggcctacggagaagcagtatgaaactctcgagaaccagctcgccttcctgtgccaacaaggtttctcccttgagaatgccctctacgcactctccgctgtagggcacttcactctgggttgcgtattggaagatcaagagcaccaagtcgctaaggaggagagggaaacacctactactgatagtatgccgccactgctccgacaagctatcgagctcttcgatcaccaaggtgcagagccagccttcctgttcggccttgaattgatcatatgcggattggagaagcagctgaagtgtgaaagtgggtcttaa

SEQ ID NO: 129 - DNA, 12326 bp, Artificial
  PHP89484 T-DNA+
aattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggtacctcgcgactcgagaaggccatttagtcctagcgatatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagagggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgttaaacaatttgtcatctgtttcggctttgatatactactggtgaagatgggccgtactactgcatcacaacgaaaaataataataagatgaaaaacttgaagtggaaaaaaaaaaaacttgaatgttcactactactcattgaccataatgtttaacatacatagctcaatagtatttttgtgaatatggcaacacaaacagtccaaaacaattgtctcttactataccaaaccaagggcgccgcttgtttgccactctttgtgtgcaatagtgtgattaccacatctccacattcaatatattccctgaattatctgacgattttgatggctcactgttttcccaagtcttgaattgtcttctgtgcgccagtcaaatgcatatgtgttgagtttatcttttaaatatcaagcttttgtttttaacttttgtttgtaaccaaaaactcacagtaggagtttgatcacataattttatgtttgcctttgcaatttctagtgagtctttgattaaaagcttgaaaagaaaatgcagccaagcttaccaagtaagttatgtgtattaaccagaggaagagagaatcttgcaaaatttcaacaaacacaaaaagaagtattactacgattggtggagaaagaaaacgattccaaatcttgaactgttgttgtaaaagcatagcagaaagtgggagacaaccgaaatagaaatgactataacttaatttaatgttatcattataatttcttctagcaaatatttagaaagtaaatatcacatcaacctttaatgtaattaagctttctctttttgattcatgtgagatgaaaagaaaaaaaagaagagaaaagtgtagaaaacacatcatttctaagctgaagccacttacgcttgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccagaccgatatcgctatcaactttgtatagaaaagttgggccagaatggcccggaccgggttaccaagcggccgcgaattccagaagaccaaagggcaattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacccatggaaactcaacaacaacaagcagatattcaagattttgggaacaaaaacagtaacacctatgcatgcaggcaaagcagtactaggtggacacccacaagtgatcagatcagaatactgaaagagctctactacaacaatggaatcagatcaccaactgctgatcagattcagagaatcgctgctcaactcagacagtacggcaagattgaaggcaagaacgtgttttattggtttcagaaccataaagctcgtgaacgccagaagaaacggttcactcctactgctcctccaccaccgtctcacttctccgatcatattaaccaccatcttcccaacgctgcccccatgcagattccgtctcaccaccaccactaccaccatcaagaaccaccacatgtctatgctcaccctcacaaactctacaccactcatcacattggggttggttcttcttcacaaggagtgatgggtgtagggtgtggctatggatctgttgctatggagaagagtttcaggaagtgttcaatatcaccaccgggagagagtaaggccacaggaggaattggccggaatatcggttcaagatcacggataagtgtcgattcgtgttccttcttcgacacaattaagccaaagacatatgagatgtttgagaatcatgatcaagatgaagaacaaggagagccttcaactgagatcgaaacacttccattattcccgattcacgacggcaaccatcatgatttcttcggcatgaggacggcaaatctgcaattggagcaaggcactggaggttactacactggaggaagctggtatcggtctgatgagagggcgtctcttgagctcagtctcaactcatatggttattataactaattcgaactggccaggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggctcggcgttaggcttttagtccgctaggtggctagaccgaggttaggacgctagttcactaggggcctagtggtgttttaaggatgggcaagtttgtacaaaaaagcaggctccggccagaatctcactgactagctaaacagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatccca

SEQ ID NO: 130 - DNA, 8476 bp, Artificial Sequence
  PHP93161
ccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcgagctcggtaccctgggatccgatctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaagtggccgttaacggatcggccagaatggcccggaccgaagccgaggccggccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggggaggagggcgtgttgcgcgaaggaaggcgttaagagaggggcgtggacgagcaaggaggacgatgccttggccgcctacgtcaaggcccacggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagatccacgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatttccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtgtccatgacctacgccttccggccaggccaagggttgcccggcaggagtttcgcgagcgacgagcatgtctggctgtgcaacgcgcacctcgccggcagcaaagccttcccccgcgcgctcctcgccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagacgggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggatagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcacgatggacgccggcaccagcaacgtcaccgtcaccgtctcggacaaggatgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaacccctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctggagtccgacgaggactggctccgctgtcagacggccgggcagcttgcgtagtggccaggtaccactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttggcgcgccggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 131 - DNA, 10104 bp, Artificial Sequence
  PHP92349
aattacaacggtatatatcctgtcagccaacaccaaaacatcaaaaaaatcgggatcaggatcaggatctgcggccgcatcctgcaggtttaaacggccggccttcactagctagctgctaagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaatcgagctagttaccctatgaggtgacatgaagcgctcacggttactatgacggttagcttcacgactgttggtggcagtagcgtacgacttagctatagttccggacttacctaactgactagagtcacacttagctgaccctagtcacttaataacttcgtatagcatacattatacgaagttatggcgcgccaagcttggatctcctgcaggatctggccggccggatgggcggatctcgtacctcaactttgtatagaaaagttgggccgaattcgagctcggtacggccagaatggccatctggattcagcagggggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccctgggatccgatatcgatgggccctggccgaagcttggtcacccggtccgggcctagaaggccgatctcccgggcacccagctttcttgtacaaagtggcccggggcggccgaagctggccttctaggcccggaccggaattcctcgaggcggccgcctaactaactaggggtttacttattttgtgggtatctatacttttattagatttttaatcaggctcctgatttctttttatttcgattcaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatgtgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaaggttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctaggttaagtaatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtacctagatcttgttaactgagctcttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgttaaacaatttgtcatctgtttcggctttgatatactactggtgaagatgggccgtactactgcatcacaacgaaaaataataataagatgaaaaacttgaagtggaaaaaaaaaaaaacttgaatgttcactactactcattgaccataatgtttaacatacatagctcaatagtatttttgtgaatatggcaacacaaacagtccaaaacaattgtctcttactataccaaaccaagggcgccgcttgtttgccactctttgtgtgcaatagtgtgattaccacatctccacattcaatatattccctgaattatctgacgattttgatggctcactgttttcccaagtcttgaattgtcttctgtgcgccagtcaaatgcatatgtgttgagtttatcttttaaatatcaagcttttgtttttaacttttgtttgtaaccaaaaactcacagtaggagtttgatcacataattttatgtttgcctttgcaatttctagtgagtctttgattaaaagcttgaaaagaaaatgcagccaagcttaccaagtaagttatgtgtattaaccagaggaagagagaatcttgcaaaatttcaacaaacacaaaaagaagtattactacgattggtggagaaagaaaacgattccaaatcttgaactgttgttgtaaaagcatagcagaaagtgggagacaaccgaaatagaaatgactataacttaatttaatgttatcattataatttcttctagcaaatatttagaaagtaaatatcacatcaacctttaatgtaattaagctttctctttttgattcatgtgagatgaaaagaaaaaaaagaagagaaaagtgtagaaaacacatcatttctaagctgaagaagcttggcgcgccggtcacccggtccgggccattctggccgatccgttaacgcccgggcaactttattatacaaagttgatggtacggatccgtcgacggcgcgccgcggacctgaattccagcacactggcggccgttaataacttcgtatagcatacattatacgaagttatagtggcatcacgtttctagttctagacccatcagctgaggtacaaattaattaataagtgactagggtcacgtgaccctagtcacttatgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgcca

SEQ ID NO: 132 - DNA, 28390 bp, Artificial Sequence
  pVIR9
gacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtagacaggaaggaccgaataatggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtcatgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatagcctgcgaaatgatcttaatggtgcaattcgtttcaggcggcatgttgcggttcaacaaagtgtacgccagatcccaattggccctttacgaggtgtcggtatgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctgataagtcgccaatatagtgatcatttgcagtattcgcatcgatcgctggttgatattctgccgctggtcgaccggctgctcgtcgccaaaaatgctcacagggatacgatggcctcggtcaggccgcgtgcgtcctgtctttccagttcctccctttcagctcgattgtggcatcatttattgcctgctcattgcagttgaaacgcgatatccgtttcaagacccgggtatggatggtactttggagatatgagcacttgccagacttcccggtcggagacttaaaaattccgataagaggttacggacgacggaccttataagtggatcgtctagtggtggcgccgatcaaaacagttccgcccccggctttgctcaaagtagcaaagcagctttatctcgggttgcggaggattttctagaaaaccgcaattttgcaggagagaacatatggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtgagacgatggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttgacgttcctgctgccgcgtcaacgaggaagctcgtttgacccgggtttgccaatgaaagggctcaatcatggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaaggtggaacgcgtctaggcttgcctatcatcaccacctcatgatggtcgcggagaccttcgaagagatatccgacatcattggagaagctgggccggaaactagtgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaagctgttttctggtattt

SEQ ID NO: 133 - DNA, 7515 bp, Artificial Sequence
  dCAS9~EAR
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatggcaccgaagaagaagcgcaaggtgatggacaagaagtacagcatcggcctcgccatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgacgccatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggctgaagctcggtccgccaggtggaggcggcagcggtggcggaggctccggaggcggtggcggtggaggcggctcgggtggcggaggctccggaggcggtggctcggaccttaacctgcccccctaggggggtggtggaagcggtggaggcggctcgggcggaggagggtcgctggagctcaagctcgggcctccgggcggaggaggttccgggggtggaggcagcgggggaggtggatccctcgagctcagcctcggcctcccgtagtgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcacccc

SEQ ID NO: 134 - DNA, 1522 bp, Agrobacterium tumefaciens
ctaccggcgcggcagcgttacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattgccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtaggggg

SEQ ID NO: 135 - DNA, 2400 bp, Agrobacterium tumefaciens
cacctaaacgaaggccgggccactcacccggccttttttgtacgctcatagggcagaacaaaccaacgttttatctataccgctacagggtatttaattcctatttaatctgcgctagaatgaggcatgtttaaccgaatctgacgttttccctgcaaatgccaaaatactatgcctatctccgggtttcgcgtgacggccaagacccggaaaaccaaaaatacggtttgctcgaatacgcgaacgccaaaggcttcgcgccgctacagatcgaggaagaaattgccagcagagcaaaggactggcgcaagcgcaagctcggagcaatcatcgaaaaggccgagcgtggcgacgtgctactgacgccggagattacgcgcattgccggttccgccctcgccgccttggaaattctcaaagcggcgagcgagcgcggcctaatcgtccatgtgaccaaacagaagatcatcatggacggcagcctacaaagcgacatcatggcaaccgtgcttggcttggctgcacagatcgagcggcatttcattcaggcacgtaccaccgaggcgctacaagtcgccagagagcgcggcaagacgctcgggcgacccaagggcagcaaatcgagcgccttgaagctggacagccgtattgatgaagtacaggcatacgtgaaccttggcttgccgcaaagtcgcgcagccgagttgttaggcgtcagccctcacaccttgcgcctgttcatcaaacgccggaacatcaaacccacaaacactagaccaaccatcaccatgccggggagggaacaacatgcctaagaacaacaaagcccccggccatcgtatcaacgagatcatcaagacgagcctcgcgctcgaaatggaggatgcccgcgaagctggcttagtcggctacatggcccgttgccttgtgcaagcgaccatgccccacaccgaccccaagaccagctactttgagcgcaccaatggcatcgtcaccttgtcgatcatgggcaagccgagcatcggcctgccctacggttctatgccgcgcaccttgcttgcttggatatgcaccgaggccgtgcgaacgaaagaccccgtgttgaaccttggccggtcgcaatcggaatttctacaaaggctcggaatgcacaccgatggccgttacacggccacccttcgcaatcaggcgcaacgcctgttttcatccatgatttcgcttgccggcgagcaaggcaatgacttcggcattgagaacgtcgtcattgccaagcgcgcttttctattctggaatcccaagcggccagaagatcgggcgctatgggatagcaccctcaccctcacaggcgatttcttcgaggaagtcacccgctcaccggttcctatccgaatcgactacctgcatgccttgcggcagtctccgcttgcgatggacatttacacgtggctgacctatcgcgtgttcctgttgcgggccaagggccgccccttcgtgcaaatcccttgggtcgccctgcaagcgcaattcggctcatcctatggcagccgcgcacgcaactcgcccgaactggacgataaggcccgagagcgggcagagcgggcagcactcgccagcttcaaatacaacttcaaaaagcgcctacgcgaagtgttgattgtctatcccgaggcaagcgactgcatcgaagatgacggcgaatgcctgcgcatcaaatccacacgcctgcatgtcacccgcgcacccggcaagggcgctcgcatcggcccccctccgacttgaccaggccaacgctacgcttggcttggtcaagccttcccatccaacagcccgccgtcgagcgggcttttttatccccggaagcctgtggatagagggtagttatccacgtgaaaccgctaatgccccgcaaagccttgattcacggggctttccggcccgctccaaaaactatccacgtgaaatcgctaatcagggtacgtgaaatcgctaatcggagtacgtgaaatcgctaataaggtcacgtgaaatcgctaatcaaaaaggcacgtgagaacgctaatagccctttcagatcaacagcttgcaaacacccctcgctccggcaagtagttacagcaagtagtatgttcaattagcttttcaattatgaatatatatatcaattattggtcgcccttggcttgtggacaatgcgctacgcgcaccggctccgcccgtggacaaccgcaagcggttgcccaccgtcgagcgccagcgcctttgcccacaacccggcggccgcaacagatcgttttataaatttttttttttgaaaaagaaaaagcccgaaaggcggcaacctctcgggcttctggatttccgatcaacgcaggagtcgttcggaaagtagctgttccagaa

SEQ ID NO: 136 - DNA, 3207 bp, Agrobacterium tumefaciens
cacctaaacgaaggccgggccactcacccggccttttttgtacgctcatagggcagaacaaaccaacgttttatctataccgctacagggtatttaattcctatttaatctgcgctagaatgaggcatgtttaaccgaatctgacgttttccctgcaaatgccaaaatactatgcctatctccgggtttcgcgtgacggccaagacccggaaaaccaaaaatacggtttgctcgaatacgcgaacgccaaaggcttcgcgccgctacagatcgaggaagaaattgccagcagagcaaaggactggcgcaagcgcaagctcggagcaatcatcgaaaaggccgagcgtggcgacgtgctactgacgccggagattacgcgcattgccggttccgccctcgccgccttggaaattctcaaagcggcgagcgagcgcggcctaatcgtccatgtgaccaaacagaagatcatcatggacggcagcctacaaagcgacatcatggcaaccgtgcttggcttggctgcacagatcgagcggcatttcattcaggcacgtaccaccgaggcgctacaagtcgccagagagcgcggcaagacgctcgggcgacccaagggcagcaaatcgagcgccttgaagctggacagccgtattgatgaagtacaggcatacgtgaaccttggcttgccgcaaagtcgcgcagccgagttgttaggcgtcagccctcacaccttgcgcctgttcatcaaacgccggaacatcaaacccacaaacactagaccaaccatcaccatgccggggagggaacaacatgcctaagaacaacaaagcccccggccatcgtatcaacgagatcatcaagacgagcctcgcgctcgaaatggaggatgcccgcgaagctggcttagtcggctacatggcccgttgccttgtgcaagcgaccatgccccacaccgaccccaagaccagctactttgagcgcaccaatggcatcgtcaccttgtcgatcatgggcaagccgagcatcggcctgccctacggttctatgccgcgcaccttgcttgcttggatatgcaccgaggccgtgcgaacgaaagaccccgtgttgaaccttggccggtcgcaatcggaatttctacaaaggctcggaatgcacaccgatggccgttacacggccacccttcgcaatcaggcgcaacgcctgttttcatccatgatttcgcttgccggcgagcaaggcaatgacttcggcattgagaacgtcgtcattgccaagcgcgcttttctattctggaatcccaagcggccagaagatcgggcgctatgggatagcaccctcaccctcacaggcgatttcttcgaggaagtcacccgctcaccggttcctatccgaatcgactacctgcatgccttgcggcagtctccgcttgcgatggacatttacacgtggctgacctatcgcgtgttcctgttgcgggccaagggccgccccttcgtgcaaatcccttgggtcgccctgcaagcgcaattcggctcatcctatggcagccgcgcacgcaactcgcccgaactggacgataaggcccgagagcgggcagagcgggcagcactcgccagcttcaaatacaacttcaaaaagcgcctacgcgaagtgttgattgtctatcccgaggcaagcgactgcatcgaagatgacggcgaatgcctgcgcatcaaatccacacgcctgcatgtcacccgcgcacccggcaagggcgctcgcatcggcccccctccgacttgaccaggccaacgctacgcttggcttggtcaagccttcccatccaacagcccgccgtcgagcgggcttttttatccccggaagcctgtggatagagggtagttatccacgtgaaaccgctaatgccccgcaaagccttgattcacggggctttccggcccgctccaaaaactatccacgtgaaatcgctaatcagggtacgtgaaatcgctaatcggagtacgtgaaatcgctaataaggtcacgtgaaatcgctaatcaaaaaggcacgtgagaacgctaatagccctttcagatcaacagcttgcaaacacccctcgctccggcaagtagttacagcaagtagtatgttcaattagcttttcaattatgaatatatatatcaattattggtcgcccttggcttgtggacaatgcgctacgcgcaccggctccgcccgtggacaaccgcaagcggttgcccaccgtcgagcgccagcgcctttgcccacaacccggcggccgcaacagatcgttttataaatttttttttttgaaaaagaaaaagcccgaaaggcggcaacctctcgggcttctggatttccgatcaacgcaggagtcgttcggaaagtagctgttccagaactagattgcgcgtcccccttggtcaaattgggtatacccatttgggcctagtctagccggcatggcgcattacagcaatacgcaatttaaatgcgcctagcgcattttcccgaccttaatgcgcctcgcgctgtagcctcacgcccacatatgtgctaatgtggttacgtgtattttatggaggttatccaatgagccgcctgacaatcgacatgacggaccagcagcaccagagcctgaaagccctggccgccttgcagggcaagaccattaagcaatacgccctcgaacgtctgttccccggtgacgctgatgccgatcaggcatggcaggaactgaaaaccatgctggggaaccgcatcaacgatgggcttgccggcaaggtgtccaccaagagcgtcggcgaaattcttgatgaagaactcagcggggatcgcgcttgacggcctacatcctcacggctgaggccgaagccgatctacgcggcatcatccgctacacgcgccgggagtggggcgcggcgcaggtgcgccgctatatcgctaagctggaacagggcatagccaggcttgccgccggcgaaggcccgtttaaggacatgagcgaactctttcccgcgctgcggatggcccgctgcgaacaccactacgttttttgcctgccgcgtgcgggcgaacccgcgttggtcgtggcgatcctgcatgagcgcatggacctcatgacgcgacttgccgacaggctcaagggctgatttcagccgctaaaaatcgcgccactcacaacgtcctgatggcgtactaagctggg

SEQ ID NO: 137 - DNA, 3085 bp, Agrobacterium tumefaciens
accgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctat

SEQ ID NO: 138 - DNA, 3604 bp, Agrobacterium tumefaciens
atggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctag

SEQ ID NO: 139 - DNA, 14902 bp, Agrobacterium tumefaciens
ctttccgacgctcaccgggctggttgccctcgccgctgggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccttgccattgccgggatcggggcagtaacgggatgggcgatcagcccgagcgcgacgcccggaagcattgacgtgccgcaggtgctggcatcgacattcagcgaccaggtgccgggcagtgagggcggcggcctgggtggcggcctgcccttcacttcggccgtcggggcattcacggacttcatggcggggccggcaatttttaccttgggcattcttggcatagtggtcgcgggtgccgtgctcgtgttcaattcagcgggttcgtgcgatccgtctgcatgatggtgatagccgtcagcatgattttcgtgtcgtcgaacttggtgaagggcattctcggcggcgatcacgacgccggccctgcggagccttcgccgcgtgcgcgattcatggcggccgtggaggccaaggatttcgcgcgagtgcaagagctgatcgaggcgcgtggagccaagtcggcggctgattatgtccttgcgcagctcgccgtggccgaaggtctggaccgcaagcctggtgcgcgcgtcgtggtcgggaaagcggcgggcagcatggcaatgccgcctgcggcgctgggttttacgccaaggggagaagcggcatacgccatcgagcggtcagcctatggtgagccgaggtccagcattgcgaagcagtaccagcaggaatggaaccggaaggcggcgacctggtgggcgatggccggtgtggccggcatcatcggcgcgatcctggcggcggcggcaaccggctttgttgggctggcagtgtcgatccgcaaccgagtgaagcgcgtgcgcgacctgttggtgatggagccgggtgcagagccataagcggcaagagacgaaagcccggtttccgggcttttgttttgttacgccaaggacgagttttagcggctaaaggtgttgacgtgcgagaaatgtttagctaaacttctctcatgtgctggcggctgtcaccgctatgttcaaccaaggcgcggagcaaattatgggtgttatccatgaagaaacggcttaccgaaagccagttccaggaggcgatccaggggctggaagtggggcagcagaccatcgagatagcgcggggcgtcttagtcgatgggaagccacaggcgacgttcgcaacgtcgctgggactgaccaggggcgcagtgtcgcaagcggtgcatcgcgtgtgggccgcgttcgaggacaagaacttgcccgaggggtacgcgcgggtaacggcggttctgccggaacatcaggcgtacatcgtccggaagtgggaagcggacgccaagaaaaaacaggaaaccaaacgatgaaaactttggtcacggccaaccagaaaggcggcgtcggcaagacttcgacccttgtgcatcttgccttcgactttttcgagcgcggcttgcgggttgccgtgatcgacctggacccccagggcaatgcgtcctacacgctcaaggactttgctaccggcctgcatgcaagcaagctgttcggcgctgtccctgccggcggctggaccgaaaccgcacccgcagccggcgacggccaggccgcgcgcctcgccctcatcgagtccaacccggtactggcgaacgccgaacggctgtcgctggacgacgcccgcgagctgttcggggcgaacatcaaggccctggcgaaccaaggcttcgacgtgtgcctgatcgacacggccccgacccttggcgtcggcctggcggccgccctcttcgcggccgactatgtgctgtcccccatcgagcttgaggcgtacagcatccagggcatcaagaagatggtcacgaccattgcgaacgtgcgccagaagaacgccaagctgcaattccttggcatggtgcccagcaaggtcgatgcgcggaatccgcgccacgcgcgccaccaagccgagctgctggccgcgtaccccaagatgatgattccggccaccgttggcctgcgcagcagcatcgccgatgccctcgcatccggtgtgccggtctggaagatcaagaaaacggccgcgcgcaaggcatcgaaagaggttcgcgccctggctgattacgtgttcacgaagatggagatttcccaatgactgcggctcaagccaagaccaccaagaaaaacaccgctgcggccgctcaggaagccgcaggcgcggcgcagccgtccggcctggggttggatagcatcggcgacctgtcgagcctcctggacgctcctgcggcgtctcagggcggttccggccctatcgagctggacctggacctgatcgacgaagatccgcatcagccgcggacggccgacaaccccggcttttccccggagagcatcgcggaaatcggtgccacgatcaaagagcgcggggtgaagtcacccatttcggtgcgcgagaaccaggagcagccgggccgctatatcatcaatcacggcgcccgccgctaccgtggctcgaagtgggccggcaagaagtccatcccggcgttcatcgacaacgactacaacgaagccgaccaggttatcgagaacctgcaacgcaacgagctgaccccgcgcgaaattgccgacttcattggccgcgagctggcgaagggcaagaagaaaggcgatatcgccaaggaaatcggcaagtcgccggcgttcatcacccagcacgtcacgctgctggacctgccggagaagatcgccgatgcgttcaacaccggccgcgtgcgcgacgtgaccgtggtgaacgagctggtgacggccttcaagaagcgcccggaggaagtcgaggcgtggcttgacgacgacacccaggaaatcacgcgcggcacggtcaagctgctgcgcgagttcctggacgagaagggccgcgatcccaacaccgtcgatgccttcaacggccagactgatgccgagcgtgacgcggaggccggcgacggccaggacggcgaggacggcgaccaggacggtaaggacgccaaggaaaagggcgcgaaggagccggacccggacaagctgaaaaaggccatcgtccaggtcgagcacgacgagcgccctgcccgccttatcctcaaccgtcggccgccggcggaaggctatgcctggttgaagtacgaggacgacggccaggagttcgaggcgaaccttgccgacgtgaaactggtcgcgctcatcgagggctgatccccaaagacagcggcgcgggccacccgcgccgcacagacaacggttccgctacaaggaggaccgaagaatgaatccgatgctgttctacatcgcgggaggcgtaggcgcggcgttgctgctggtttccgcgatcatgctgttcaagctgcgcgagccgaagaaggaacaccgaccgcagcgcaaggcggcggccccgacgccgcagccggtcgataacgagctgctgcgcacctttcgccggccgtcgcaggccagccaacccgagccatccacgacgccgccggcgcggcgcactgccccgccgagcagcgaacaatccagagggaatgacggcgatttcgtcacgtcggccctggtggccggggcgaccaacagcaccatgctgggctacctggccggcggctcgctgaccggggccatgctgggcgatgcgctgcggccggatacgccgtctgcggcgttcgcggacccctcgccgtgcttcggcagcagcgacacggacagcggctggaccgataccggcagctcttgcgatttcagttcgtccgacaccgatacgaacaactggtgagggcggaccatgactgacgaacaaaagaaacggctcctgatgttgcaagctatccggcgcagcatccaggcaatgcgcaggggtgtttcggggccggatagtttcaagggctggttgaccggcatcggcatcatcgcggcggggttcctggttggcgagctgctgccatcccctgcccccggcgtcggcctggttgtgccaggggcctgcattgccggcttcgtcgtcggctgctggctcaacaggaaaggccgctcatggccgacagccatttacgaccaattggcccgttaccagccgctcaacgagcgggcgtaccgcgacctgcaagagacggtgaaggaacgcggcctcgactgcgatgcggtcatggagtggacctacatcgagcaggccgagttcatgcccctggtgcccaccagggaggacctagcgcgcgacaagttcctgaccgcgacgcgggccgatagggccgaggacgatgcgcgtgcgcgcttcgtcgtgctccatcccaagaagcgcggccccgacgcatgaagaagcccgacgcccgctaatccccttcccgctgaccctttgcccccgccgaccgtgcggggctttttttgcctgcccttcagccgctaaaaaacctgccgttaagtcgagaactgttcagctaaactcttgcgctgataaggtaggtaagagtattattattcttaccaattaccggagccaacatggaactgaacaaagagacgcgcgaccgcatttttgcggctgcggacgagctgttcgagcaaggcgaccgggagaacttcccgaccgtggatgcagtgcgtaaggccgcccgcgtcaacatgaacgacgccagcgccggcatgcgcgaatggcgacgccagcgcacggcgcaggccgccccgctggcagtccaggtgccggacgcggtgcagcaggccggcaaccaggccgtggccgccctctggcaagccgcccaggcccttgccaatgaatcgttgcaggcagcgcaagccggctgggatcgtgagcgcaacgagttggaagccgtgcgcggggagctggccgacgccttcgaggcgcaggcccgcgagctggaagaagcccaggcgcgcgttacattgctagagcagcaggccgccgaggcggccgagctggccgcacgccagcggcaagccctggccgaagcacgcaccgccctggcaggagccgagcagcgggccgcgctggcgacgcagcgggccgacgaggtggagcgtcgagcgcaggagctgcgcgccgagctggactacgctcaccaggacgcccgcgcattcaaagaagagagccgcaagaccctggacgcggccaaccaggaaatgcaggcgcttcgcggcgagcgcgacgccaccaggcgcgaagcggagagtttgcgcacggagttggcagcggtgaaagcgaaggcgcaggccgacgccgaggcccaccaggagcaaaggaagttggcggcgcaagaggcggccaggcaggccgagcgctttacgacggtgcaagccgagcgtgacgaagcgcggcaagaggcaaaggcagcccaagaagaggccgctatgttgaggggtcggctagacgcggaaacgagtgggaggaaacacaaagcgggaggaaagtaactgataaatcgaacgcagttcactaaaatagatggaacaaccttgacgcgcccggctctagggaaagccggcctcgaactgccgaggtcggcttttttttagccggcaagcgaccaggacacgtttaacaccagaggcaaccgtcaggagtcacccaatgaaacaccgcctcctggtcatgaatgggcaaagaattgtccagaccgagaaccaaggcgcatggacgaaccagaaggtagataaagccggggccctgaaacctggcatttacaacatctatatggcccaaaaggccgataagtcgcagcgccacgacggcagcatcgtccacgcagatagcggcagcatttaccaacaggtggggaagaactttgtaatgcacgcccggtcagatttcgataaagtacctgaaatcgggagtgcgaaaagcatcacctatgacgcaagtggcaaggcacaggtaagtgccgaaagcgtcaagttgagtcgcgggcgcactcgttagagttttagcggctaaaaagggaggcgtcttgagcagctacagcagagccgagcgcgcaccgtggggagacttcccgaaggtggttcgcaacggcgaccttggttctttgaccaacgagcctgaataccaggctgcgaagcagggcgacgcggaagcggcgcttaatttggtcgagcgcctgatttcggacgacactgttgcccagctcaagacgctgatcggcgacgacaagccccgcatcgttccagtcctcgccgtcgaggcggcggggaacaacaagattccggccatgatggcggtcgttctggccgaccgccttggccttgaggtcgaaacggacattgtgcagcgggagaaggtcgcccgaaccggagccggttcagatcatcgcctggcgttcaacccgactttcgagggggaggtgatccccggccagaagtacatcgttgtcgatgacacgctgacgatgggcggcaccattgcctcattacgcggctacatcgagaacaacggcggcaaggtcatggcggcgtccgtcatgaccgcccatgaaggcgcgcttgacctggcggtcaagccgaagatgcttgcgggcatcaatgagaaacacggtccagcaatggacgcattttggaaggaaacctttggctatggcatcgaccgactcacccaaggagaagccggacacctccgcgctgccccgtccgttgacgcaatccgagatcgcatcgctgcggctcgaaatgaagcagtcaatcgagtgggggcaagccgaactgcgacgacggcgcgagcagggcaacagcagtccccggcagtaaagcagtccagcggcaacagcggcgaggatttgctacaggcggcccaggaggccgagacggaacagcaggccctcttagaatccgcgcccatcgagcagacctaccagcagacccttgcgctctacgtgcaggcaaagcatgaccaggtggagcgcatcgaggaccgcctagaacagctcgtagaccgtcagcaggcgcgtttgcagcagctacagtccaatgcccccggcttgctgtccctgccgcgtacaaaggccgcctggcagcagcagcaggcccaacagcaagcccgcttgcagaccctgcacacgcggctggacatggtgcgcgaaatcaaggaaggcatgggcattcacgcgcccaagatcgaggaactggcgacgcgcaagatgcgcgcggagcatcccgagctggccggcgactgggattcgatgcgtgaagcagcccgacggcaccaggccctgatgcgcaagcaggagcaggagaagaaacaggcccaggagcgcgagcgcgggcgcagtcagagcttgggcctgtcaaacaagcccagctaacgcaaaaacaaagcccggcaacgccgggctttttcatctgcgcctctgcgattcataacgaggcccacaccaccagggcggccgcgaacaacaccatgccgccggcgatcatgttcatcatcgccacgcgccgcgcgtccgcgaccttggccgcgagctggcggccaaggccgtcgtcgatttccctgcggatcgcttcggccgcctgcgcggcgctgtccttcattaccttcgccattgcgtccttgctggccgccagggccgcgttcagcatccgctccgctttggccttggcgtcctcgccccaacgatgggcgatcccttccagctcttccttgaacgcggcaaggatttcctcttgcttggccgcactgtcggccatgagccgggcgttgatggtatgcaggatcagcaccgggtcgtcgcggccgacggcgatgccgtgcttggccgcaatctcccggatcagctcttcaatctggtcgctcatagcacggccgccgcgtcgagctgttcaaacaggccgcgccgcacgatcttgaggcgttgccgcgtcatgatcgtgagcgattcatcggccagcgcctggtcgaacgtcagccgctcttgcagcatgtcgctgaaatcgcggccgtaggtttcttccttgagggccggaatctggatgatggacgacacgcgggccttgttggccgtgtacgccttcatctgctcaaagctcttgccctcatgctcgataggcccccaatacgggttcagccagaccacgaaaagcgcttcggccgggaactggctggcgagctgggcgaagccgctcaccgtgtccaggagagcctggccgccggtgacgacggtatggatgaccagctcatgccccatttcttgcagcagagccggcacctggttgctgatgaggtaatgcgacagaggcacgaacgagctggcaccgttgtcgatcaccacgtcatccttggtcggcgcaatcagctcgaccagggtgtcgaagttgcgcgagttaatttcgtcgccggccatgatgttcagccggcggacgttcagggccttgtagccctcgaacgtcgcgttcaccgggtcggtgtcgatgcacaagggtgtctgccccttgtccatcttgtactgcgcaatgatcgcggcgatggccgacttgccgaccccgcccttgccctgcaaaaccatgtgaattttcgccattacagtagatcctttttgtccggtgttgggttgaaggtgaagccggtcggggccgcagcgggggccggcttttcagccttgcccccctgcttcggccgccgtggctccggcgtcttgggtgccggcgcgggttccgcagccttggcctgcggtgcgggcacatcggcgggcttggccttgatgtgccgcctggcgtgcgagcggaacgtctcgtaggagaacttgaccttccccgtttcccgcatgtgctcccaaatggtgacgagcgcatagccggacgctaacgccgcctcgacatccgccctcaccgccaggaacgcaaccgcagcctcatcacgccggcgcttcttggccgcgcgggattcaacccactcggccagctcgtcggtgtagctctttggcatcgtctctcgcctgtcccctcagttcagtaatttcctgcatttgcctgtttccagtcggtagatattccacaaaacagcagggaagcagcgcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtgaagtacatcaccgacgagcaaggcaagaccgagcgctcttcttcaatcgctgccgtcagacggtcagggaacgccgacaggccccgctccgcgtagttcggagcaggacgccgcacggcgtccacatggatcatccacccacttcccaggcccgcgagggcctggttgatgcgggcggacactacttcgcgctgctggtcggtgctgcttgcgttgtcatcgcccttgtacagccaggcagccataaagctgccgttcttgcccacgattacgccgtcatcgacgacagcggcgtagttgagcagatcggccaggccggcgtccttggaacgatgctttttcagtttcagttcggcatcgaccgcgcggatgcgggcaaagaggatgaacaacagaagcgcgccgaggcccgcgattgcaatcgcaattgcttggatcatcggtattgcttcccttggctattggtgttctcgcggaacggggtcgagcgggccgggtaatacggcttgtaccggcggtgacgcaggtacacgaaccgcatcttcggatcggccttcgccatgattcggaacgcatagagcgccccgaaccacaggatcagaccgaccacggtggcccgcagctcttgggcgctgaaaatcagcgcaaacgccatcaggcccgagaacatcaccagttcacgatcaccacccatgaacaggttttctcggttgcctgcgcgacggatggggatcgtgcgcagagccatgattaggcgagccgtccagccgctaccgcacgcacggcatccgccgccgcgacttgcacctggtgcagcgccccgttgccgagggccgcgatttcggcaccacgaccgaagaaggtgctcatcacgttctgcgcgccgaccagcagcgccatcaccagaaccaggaagatcagggttcggaagaaggcgttgagttcgccgccgaagatcagcacgccgccggcgacgacgatgccgatgatggacagcgcgaaggccaccgggccggttacggagttgcgcaggttcgtcagccagctctcatatggcaagctgccgccggtgccttccgaggccatcgccggatgcgcggataacgcgagagcgagaacgaagaacacggcaaggtagaacaaaatgccgcgattcatggtcagacggaacggaacagccgttgtcattggaaatactccttacagggttttggtgatgtactggccgttctcgtaaccaagaacttcgagaatttcttgcactcgacggccgctaggggtcctggcgatatggacgaccacatgaaccgcctcgccaatcagcggctcaatgggtttcggtgaatccgggtgcatgctgataagcatggcgagccggctcaggcccgctttggggttgtttgcgtgcagggtggcggcacctccttcatgcccggtgttccaggccatcaacagatcaagggcttcggggccacgtacctcaccgaccaggatgcggtcggggcgcatacgcagcgttgtcttgagcagcagcgtcatcgagacgtcgatgctggtgtggtattggacggcgttctctgcggcgcactggatttcgccggtgtcctcgatgatgacgacgcgctcagacgggttgaaggcgaccatttcattgatgatcgcgttgacgagcgtggtcttgcccgagccagtaccgccaatgacgaggatgtttcgatgcgccgcgacggcgcttttaatgacctcgtattgctcgcgggtcatgatgcccgcctcgacgtactgttccagcgtgaagatggcgaccgcgcgcttgcggatcgcaaaggttggcgcggccacgaccggcggcaattggccggcaaagcggctgccatccaaggggaactcgccttccaggatgggcgaatgccgcgtgacctctttgccgtggaatccggccaccgtttctataatcgcctgcgactggctgggccgcatgtcgcagatgtaccgcatcggctcgccaaggcgttcgtgccacaccttgccgtccgcgttgagcatgacttcaacggttttcgggtcgttgagcgcggccaacaggtccgcacccatgtcgcgttccagcttgcgcttggcccgctccttgatggtctgaaactcttctttcccgctcacttttcagtaacccctacgcaacaaatcattagcaacattatcgcacaggcaaacgatataccgaaagtgtttagcctgcaagacaaacagctaatcgaaccgcacgacgtaggggttctgatagaaaacaactgtcaaagcgcacccgcccgatgccattcgcggcacggcttccgttgaggatgtcgatatgatgcgcgagccgacggcccgcagagaaggggccgttttagcggctaaagaaggaagtgcaagccctaacccttggcgtcagagccttccacgcagcttttttcgggtgtcgtcgccccatttctttacgataaacgccttatgtgacggcaaaaccacactgatgcgttcgtatccgggcggcacgctgctcttgaaaggatgacccgcaatctccgcgagtgcctcgcggtcaaggtcggtggactccaggagaagaggtaggggagtttccagggcgtcggcaatggcctccatcaccttcaacgaggggttggccttaccgttggttaagtctgataaaaacgaaattgaaacccctgccctctccgacagctcatgtttcgtcatgccccgctcatcgagcagacgaaggatgttggtgaaaaatatctggttgtacacagcggaagccgcccctcgcacctttggtcgcggcccgcaaaattttagccgctaaagttcttgacagcggaaccaatgtttagctaaactagagtctcctttctcaaggagactttcgatatgagccataatcagttccagtttatcggtaatcttacccgtgacaccgaggtacgtcatggcaattctaacaagccgcaagcaattttcgatatagcggttaatgaagagtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctag

SEQ ID NO: 140 - DNA, 15197 bp, Agrobacterium tumefaciens
atgggtgttatccatgaagaaacggcttaccgaaagccagttccaggaggcgatccaggggctggaagtggggcagcagaccatcgagatagcgcggggcgtcttagtcgatgggaagccacaggcgacgttcgcaacgtcgctgggactgaccaggggcgcagtgtcgcaagcggtgcatcgcgtgtgggccgcgttcgaggacaagaacttgcccgaggggtacgcgcgggtaacggcggttctgccggaacatcaggcgtacatcgtccggaagtgggaagcggacgccaagaaaaaacaggaaaccaaacgatgaaaactttggtcacggccaaccagaaaggcggcgtcggcaagacttcgacccttgtgcatcttgccttcgactttttcgagcgcggcttgcgggttgccgtgatcgacctggacccccagggcaatgcgtcctacacgctcaaggactttgctaccggcctgcatgcaagcaagctgttcggcgctgtccctgccggcggctggaccgaaaccgcacccgcagccggcgacggccaggccgcgcgcctcgccctcatcgagtccaacccggtactggcgaacgccgaacggctgtcgctggacgacgcccgcgagctgttcggggcgaacatcaaggccctggcgaaccaaggcttcgacgtgtgcctgatcgacacggccccgacccttggcgtcggcctggcggccgccctcttcgcggccgactatgtgctgtcccccatcgagcttgaggcgtacagcatccagggcatcaagaagatggtcacgaccattgcgaacgtgcgccagaagaacgccaagctgcaattccttggcatggtgcccagcaaggtcgatgcgcggaatccgcgccacgcgcgccaccaagccgagctgctggccgcgtaccccaagatgatgattccggccaccgttggcctgcgcagcagcatcgccgatgccctcgcatccggtgtgccggtctggaagatcaagaaaacggccgcgcgcaaggcatcgaaagaggttcgcgccctggctgattacgtgttcacgaagatggagatttcccaatgactgcggctcaagccaagaccaccaagaaaaacaccgctgcggccgctcaggaagccgcaggcgcggcgcagccgtccggcctggggttggatagcatcggcgacctgtcgagcctcctggacgctcctgcggcgtctcagggcggttccggccctatcgagctggacctggacctgatcgacgaagatccgcatcagccgcggacggccgacaaccccggcttttccccggagagcatcgcggaaatcggtgccacgatcaaagagcgcggggtgaagtcacccatttcggtgcgcgagaaccaggagcagccgggccgctatatcatcaatcacggcgcccgccgctaccgtggctcgaagtgggccggcaagaagtccatcccggcgttcatcgacaacgactacaacgaagccgaccaggttatcgagaacctgcaacgcaacgagctgaccccgcgcgaaattgccgacttcattggccgcgagctggcgaagggcaagaagaaaggcgatatcgccaaggaaatcggcaagtcgccggcgttcatcacccagcacgtcacgctgctggacctgccggagaagatcgccgatgcgttcaacaccggccgcgtgcgcgacgtgaccgtggtgaacgagctggtgacggccttcaagaagcgcccggaggaagtcgaggcgtggcttgacgacgacacccaggaaatcacgcgcggcacggtcaagctgctgcgcgagttcctggacgagaagggccgcgatcccaacaccgtcgatgccttcaacggccagactgatgccgagcgtgacgcggaggccggcgacggccaggacggcgaggacggcgaccaggacggtaaggacgccaaggaaaagggcgcgaaggagccggacccggacaagctgaaaaaggccatcgtccaggtcgagcacgacgagcgccctgcccgccttatcctcaaccgtcggccgccggcggaaggctatgcctggttgaagtacgaggacgacggccaggagttcgaggcgaaccttgccgacgtgaaactggtcgcgctcatcgagggctgatccccaaagacagcggcgcgggccacccgcgccgcacagacaacggttccgctacaaggaggaccgaagaatgaatccgatgctgttctacatcgcgggaggcgtaggcgcggcgttgctgctggtttccgcgatcatgctgttcaagctgcgcgagccgaagaaggaacaccgaccgcagcgcaaggcggcggccccgacgccgcagccggtcgataacgagctgctgcgcacctttcgccggccgtcgcaggccagccaacccgagccatccacgacgccgccggcgcggcgcactgccccgccgagcagcgaacaatccagagggaatgacggcgatttcgtcacgtcggccctggtggccggggcgaccaacagcaccatgctgggctacctggccggcggctcgctgaccggggccatgctgggcgatgcgctgcggccggatacgccgtctgcggcgttcgcggacccctcgccgtgcttcggcagcagcgacacggacagcggctggaccgataccggcagctcttgcgatttcagttcgtccgacaccgatacgaacaactggtgagggcggaccatgactgacgaacaaaagaaacggctcctgatgttgcaagctatccggcgcagcatccaggcaatgcgcaggggtgtttcggggccggatagtttcaagggctggttgaccggcatcggcatcatcgcggcggggttcctggttggcgagctgctgccatcccctgcccccggcgtcggcctggttgtgccaggggcctgcattgccggcttcgtcgtcggctgctggctcaacaggaaaggccgctcatggccgacagccatttacgaccaattggcccgttaccagccgctcaacgagcgggcgtaccgcgacctgcaagagacggtgaaggaacgcggcctcgactgcgatgcggtcatggagtggacctacatcgagcaggccgagttcatgcccctggtgcccaccagggaggacctagcgcgcgacaagttcctgaccgcgacgcgggccgatagggccgaggacgatgcgcgtgcgcgcttcgtcgtgctccatcccaagaagcgcggccccgacgcatgaagaagcccgacgcccgctaatccccttcccgctgaccctttgcccccgccgaccgtgcggggctttttttgcctgcccttcagccgctaaaaaacctgccgttaagtcgagaactgttcagctaaactcttgcgctgataaggtaggtaagagtattattattcttaccaattaccggagccaacatggaactgaacaaagagacgcgcgaccgcatttttgcggctgcggacgagctgttcgagcaaggcgaccgggagaacttcccgaccgtggatgcagtgcgtaaggccgcccgcgtcaacatgaacgacgccagcgccggcatgcgcgaatggcgacgccagcgcacggcgcaggccgccccgctggcagtccaggtgccggacgcggtgcagcaggccggcaaccaggccgtggccgccctctggcaagccgcccaggcccttgccaatgaatcgttgcaggcagcgcaagccggctgggatcgtgagcgcaacgagttggaagccgtgcgcggggagctggccgacgccttcgaggcgcaggcccgcgagctggaagaagcccaggcgcgcgttacattgctagagcagcaggccgccgaggcggccgagctggccgcacgccagcggcaagccctggccgaagcacgcaccgccctggcaggagccgagcagcgggccgcgctggcgacgcagcgggccgacgaggtggagcgtcgagcgcaggagctgcgcgccgagctggactacgctcaccaggacgcccgcgcattcaaagaagagagccgcaagaccctggacgcggccaaccaggaaatgcaggcgcttcgcggcgagcgcgacgccaccaggcgcgaagcggagagtttgcgcacggagttggcagcggtgaaagcgaaggcgcaggccgacgccgaggcccaccaggagcaaaggaagttggcggcgcaagaggcggccaggcaggccgagcgctttacgacggtgcaagccgagcgtgacgaagcgcggcaagaggcaaaggcagcccaagaagaggccgctatgttgaggggtcggctagacgcggaaacgagtgggaggaaacacaaagcgggaggaaagtaactgataaatcgaacgcagttcactaaaatagatggaacaaccttgacgcgcccggctctagggaaagccggcctcgaactgccgaggtcggcttttttttagccggcaagcgaccaggacacgtttaacaccagaggcaaccgtcaggagtcacccaatgaaacaccgcctcctggtcatgaatgggcaaagaattgtccagaccgagaaccaaggcgcatggacgaaccagaaggtagataaagccggggccctgaaacctggcatttacaacatctatatggcccaaaaggccgataagtcgcagcgccacgacggcagcatcgtccacgcagatagcggcagcatttaccaacaggtggggaagaactttgtaatgcacgcccggtcagatttcgataaagtacctgaaatcgggagtgcgaaaagcatcacctatgacgcaagtggcaaggcacaggtaagtgccgaaagcgtcaagttgagtcgcgggcgcactcgttagagttttagcggctaaaaagggaggcgtcttgagcagctacagcagagccgagcgcgcaccgtggggagacttcccgaaggtggttcgcaacggcgaccttggttctttgaccaacgagcctgaataccaggctgcgaagcagggcgacgcggaagcggcgcttaatttggtcgagcgcctgatttcggacgacactgttgcccagctcaagacgctgatcggcgacgacaagccccgcatcgttccagtcctcgccgtcgaggcggcggggaacaacaagattccggccatgatggcggtcgttctggccgaccgccttggccttgaggtcgaaacggacattgtgcagcgggagaaggtcgcccgaaccggagccggttcagatcatcgcctggcgttcaacccgactttcgagggggaggtgatccccggccagaagtacatcgttgtcgatgacacgctgacgatgggcggcaccattgcctcattacgcggctacatcgagaacaacggcggcaaggtcatggcggcgtccgtcatgaccgcccatgaaggcgcgcttgacctggcggtcaagccgaagatgcttgcgggcatcaatgagaaacacggtccagcaatggacgcattttggaaggaaacctttggctatggcatcgaccgactcacccaaggagaagccggacacctccgcgctgccccgtccgttgacgcaatccgagatcgcatcgctgcggctcgaaatgaagcagtcaatcgagtgggggcaagccgaactgcgacgacggcgcgagcagggcaacagcagtccccggcagtaaagcagtccagcggcaacagcggcgaggatttgctacaggcggcccaggaggccgagacggaacagcaggccctcttagaatccgcgcccatcgagcagacctaccagcagacccttgcgctctacgtgcaggcaaagcatgaccaggtggagcgcatcgaggaccgcctagaacagctcgtagaccgtcagcaggcgcgtttgcagcagctacagtccaatgcccccggcttgctgtccctgccgcgtacaaaggccgcctggcagcagcagcaggcccaacagcaagcccgcttgcagaccctgcacacgcggctggacatggtgcgcgaaatcaaggaaggcatgggcattcacgcgcccaagatcgaggaactggcgacgcgcaagatgcgcgcggagcatcccgagctggccggcgactgggattcgatgcgtgaagcagcccgacggcaccaggccctgatgcgcaagcaggagcaggagaagaaacaggcccaggagcgcgagcgcgggcgcagtcagagcttgggcctgtcaaacaagcccagctaacgcaaaaacaaagcccggcaacgccgggctttttcatctgcgcctctgcgattcataacgaggcccacaccaccagggcggccgcgaacaacaccatgccgccggcgatcatgttcatcatcgccacgcgccgcgcgtccgcgaccttggccgcgagctggcggccaaggccgtcgtcgatttccctgcggatcgcttcggccgcctgcgcggcgctgtccttcattaccttcgccattgcgtccttgctggccgccagggccgcgttcagcatccgctccgctttggccttggcgtcctcgccccaacgatgggcgatcccttccagctcttccttgaacgcggcaaggatttcctcttgcttggccgcactgtcggccatgagccgggcgttgatggtatgcaggatcagcaccgggtcgtcgcggccgacggcgatgccgtgcttggccgcaatctcccggatcagctcttcaatctggtcgctcatagcacggccgccgcgtcgagctgttcaaacaggccgcgccgcacgatcttgaggcgttgccgcgtcatgatcgtgagcgattcatcggccagcgcctggtcgaacgtcagccgctcttgcagcatgtcgctgaaatcgcggccgtaggtttcttccttgagggccggaatctggatgatggacgacacgcgggccttgttggccgtgtacgccttcatctgctcaaagctcttgccctcatgctcgataggcccccaatacgggttcagccagaccacgaaaagcgcttcggccgggaactggctggcgagctgggcgaagccgctcaccgtgtccaggagagcctggccgccggtgacgacggtatggatgaccagctcatgccccatttcttgcagcagagccggcacctggttgctgatgaggtaatgcgacagaggcacgaacgagctggcaccgttgtcgatcaccacgtcatccttggtcggcgcaatcagctcgaccagggtgtcgaagttgcgcgagttaatttcgtcgccggccatgatgttcagccggcggacgttcagggccttgtagccctcgaacgtcgcgttcaccgggtcggtgtcgatgcacaagggtgtctgccccttgtccatcttgtactgcgcaatgatcgcggcgatggccgacttgccgaccccgcccttgccctgcaaaaccatgtgaattttcgccattacagtagatcctttttgtccggtgttgggttgaaggtgaagccggtcggggccgcagcgggggccggcttttcagccttgcccccctgcttcggccgccgtggctccggcgtcttgggtgccggcgcgggttccgcagccttggcctgcggtgcgggcacatcggcgggcttggccttgatgtgccgcctggcgtgcgagcggaacgtctcgtaggagaacttgaccttccccgtttcccgcatgtgctcccaaatggtgacgagcgcatagccggacgctaacgccgcctcgacatccgccctcaccgccaggaacgcaaccgcagcctcatcacgccggcgcttcttggccgcgcgggattcaacccactcggccagctcgtcggtgtagctctttggcatcgtctctcgcctgtcccctcagttcagtaatttcctgcatttgcctgtttccagtcggtagatattccacaaaacagcagggaagcagcgcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtgaagtacatcaccgacgagcaaggcaagaccgagcgctcttcttcaatcgctgccgtcagacggtcagggaacgccgacaggccccgctccgcgtagttcggagcaggacgccgcacggcgtccacatggatcatccacccacttcccaggcccgcgagggcctggttgatgcgggcggacactacttcgcgctgctggtcggtgctgcttgcgttgtcatcgcccttgtacagccaggcagccataaagctgccgttcttgcccacgattacgccgtcatcgacgacagcggcgtagttgagcagatcggccaggccggcgtccttggaacgatgctttttcagtttcagttcggcatcgaccgcgcggatgcgggcaaagaggatgaacaacagaagcgcgccgaggcccgcgattgcaatcgcaattgcttggatcatcggtattgcttcccttggctattggtgttctcgcggaacggggtcgagcgggccgggtaatacggcttgtaccggcggtgacgcaggtacacgaaccgcatcttcggatcggccttcgccatgattcggaacgcatagagcgccccgaaccacaggatcagaccgaccacggtggcccgcagctcttgggcgctgaaaatcagcgcaaacgccatcaggcccgagaacatcaccagttcacgatcaccacccatgaacaggttttctcggttgcctgcgcgacggatggggatcgtgcgcagagccatgattaggcgagccgtccagccgctaccgcacgcacggcatccgccgccgcgacttgcacctggtgcagcgccccgttgccgagggccgcgatttcggcaccacgaccgaagaaggtgctcatcacgttctgcgcgccgaccagcagcgccatcaccagaaccaggaagatcagggttcggaagaaggcgttgagttcgccgccgaagatcagcacgccgccggcgacgacgatgccgatgatggacagcgcgaaggccaccgggccggttacggagttgcgcaggttcgtcagccagctctcatatggcaagctgccgccggtgccttccgaggccatcgccggatgcgcggataacgcgagagcgagaacgaagaacacggcaaggtagaacaaaatgccgcgattcatggtcagacggaacggaacagccgttgtcattggaaatactccttacagggttttggtgatgtactggccgttctcgtaaccaagaacttcgagaatttcttgcactcgacggccgctaggggtcctggcgatatggacgaccacatgaaccgcctcgccaatcagcggctcaatgggtttcggtgaatccgggtgcatgctgataagcatggcgagccggctcaggcccgctttggggttgtttgcgtgcagggtggcggcacctccttcatgcccggtgttccaggccatcaacagatcaagggcttcggggccacgtacctcaccgaccaggatgcggtcggggcgcatacgcagcgttgtcttgagcagcagcgtcatcgagacgtcgatgctggtgtggtattggacggcgttctctgcggcgcactggatttcgccggtgtcctcgatgatgacgacgcgctcagacgggttgaaggcgaccatttcattgatgatcgcgttgacgagcgtggtcttgcccgagccagtaccgccaatgacgaggatgtttcgatgcgccgcgacggcgcttttaatgacctcgtattgctcgcgggtcatgatgcccgcctcgacgtactgttccagcgtgaagatggcgaccgcgcgcttgcggatcgcaaaggttggcgcggccacgaccggcggcaattggccggcaaagcggctgccatccaaggggaactcgccttccaggatgggcgaatgccgcgtgacctctttgccgtggaatccggccaccgtttctataatcgcctgcgactggctgggccgcatgtcgcagatgtaccgcatcggctcgccaaggcgttcgtgccacaccttgccgtccgcgttgagcatgacttcaacggttttcgggtcgttgagcgcggccaacaggtccgcacccatgtcgcgttccagcttgcgcttggcccgctccttgatggtctgaaactcttctttcccgctcacttttcagtaacccctacgcaacaaatcattagcaacattatcgcacaggcaaacgatataccgaaagtgtttagcctgcaagacaaacagctaatcgaaccgcacgacgtaggggttctgatagaaaacaactgtcaaagcgcacccgcccgatgccattcgcggcacggcttccgttgaggatgtcgatatgatgcgcgagccgacggcccgcagagaaggggccgttttagcggctaaagaaggaagtgcaagccctaacccttggcgtcagagccttccacgcagcttttttcgggtgtcgtcgccccatttctttacgataaacgccttatgtgacggcaaaaccacactgatgcgttcgtatccgggcggcacgctgctcttgaaaggatgacccgcaatctccgcgagtgcctcgcggtcaaggtcggtggactccaggagaagaggtaggggagtttccagggcgtcggcaatggcctccatcaccttcaacgaggggttggccttaccgttggttaagtctgataaaaacgaaattgaaacccctgccctctccgacagctcatgtttcgtcatgccccgctcatcgagcagacgaaggatgttggtgaaaaatatctggttgtacacagcggaagccgcccctcgcacctttggtcgcggcccgcaaaattttagccgctaaagttcttgacagcggaaccaatgtttagctaaactagagtctcctttctcaaggagactttcgatatgagccataatcagttccagtttatcggtaatcttacccgtgacaccgaggtacgtcatggcaattctaacaagccgcaagcaattttcgatatagcggttaatgaagagtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccggggaccgccgtgttgctaggatggttgttcttggatcagacgctgagtgcgcttcaaatcatcggcgtcctgctcgtgatcgggagtatctggctgggccaacgttccaaccgcactcctagattgcgcgtcccccttggtcaaattgggtatacccatttgggcctagtctagccggcatggcgcattacagcaatacgcaatttaaatgcgcctagcgcattttcccgaccttaatgcgcctcgcgctgtagcctcacgcccacatatgtgctaatgtggttacgtgtattttatggaggttatccaatgagccgcctgacaatcgacatgacggaccagcagcaccagagcctgaaagccctggccgccttgcagggcaagaccattaagcaatacgccctcgaacgtctgttccccggtgacgctgatgccgatcaggcatggcaggaactgaaaaccatgctggggaaccgcatcaacgatgggcttgccggcaaggtgtccaccaagagcgtcggcgaaattcttgatgaagaactcagcggggatcgcgcttgacggcctacatcctcacggctgaggccgaagccgatctacgcggcatcatccgctacacgcgccgggagtggggcgcggcgcaggtgcgccgctatatcgctaagctggaacagggcatagccaggcttgccgccggcgaaggcccgtttaaggacatgagcgaactctttcccgcgctgcggatggcccgctgcgaacaccactacgttttttgcctgccgcgtgcgggcgaacccgcgttggtcgtggcgatcctgcatgagcgcatggacctcatgacgcgacttgccgacaggctcaagggctgatttcagccgctaaaaatcgcgccactcacaacgtcctgatggcgtactaagctggg

SEQ ID NO: 141 - DNA, 3671 bp, Agrobacterium tumefaciens
tcagcctgccgccttgggccgggtgatgtcgtacttgcccgccgcgaactcggttaccgtccagcccagcgcgaccagctccggcaacgcctcgcgcacccgctggcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccaccatggcatcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatcaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtggtggcgtccctgacgccgatatcgaagcgctcacagcccatggccttgagctgtcggcctatggcctgcaaagtcctgtcgttcttcatcgggccaccaagcgattcccacacattatacgagccggaagcataaagtgtagctagatccgaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttag

SEQ ID NO: 142 - DNA, 436 bp, Cauliflower mosaic virus
catggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgat

SEQ ID NO: 143 - DNA, 280 bp, Citrus Yellow Mosaic Virus
caattatggagcgtgatggacccccccgcaataatccaaagtttggtgtgcttttagtagtgcgtctttatggaccactactttattgtaataatcgatgctttttgtagtgcgctcttcgtgcgctctactttatgcttttgcttttgtaagtgcgctgtaagtgcgcctgtctttcttcagatgcttatcctttaagcatcttttgctttttgcgtggcatcctttagttcacaatttaaagaatgacgatggggcccaagatgtgcacccggttctc

SEQ ID NO: 144 - DNA, 293 bp, Banana Streak Virus
gccagaagatagaagatatcctggacctgcaagatgtcagcaatgacgattgaaagattcccaggatagccggcggacgtggtggacccagtctaggtgcgatgcttagtcacgcacgatgactctgtcggaaggcatctttactttcggcaaactttaataatactttaggaaaagtattgtacaagttaggtgcagaatcaataatgcacccagctttagtcttgtctactgaattattgtgtcggttgcattattggatgcctgcgtgcaccctaagcaatccccggctc

SEQ ID NO: 145 - DNA, 202 bp, Figwort mosaic virus
atcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaa

SEQ ID NO: 146 - DNA, 184 bp, Peanut chlorotic streak virus
caacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgacc

SEQ ID NO: 147 - DNA, 187 bp, Mirabilis Mosaic Virus
ccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatccca

That which is claimed:

1. A method of producing a transgenic maize plant comprising:

contacting a maize plant cell with a T-DNA containing a trait gene expression cassette and a T-DNA containing a morphogenic gene expression cassette;

selecting a maize plant cell containing the trait gene expression cassette and no morphogenic gene expression cassette; and regenerating a transgenic maize plant from the selected plant cell, wherein the morphogenic gene cassette is not excised from the genome of the selected maize plant cell, wherein the contacting comprises bacteria-mediated transformation that is mediated by bacteria of a disarmed *Agrobacteria* strain and/or an *Ochrobactrum haywardense* H1 strain, wherein the contacting comprises contacting the maize plant cell with the T-DNA containing the trait gene expression cassette in a first group of bacteria and contacting the plant cell with the T-DNA containing the morphogenic gene expression cassette in a second, different group of bacteria, and wherein the morphogenic gene expression cassette comprises a nucleotide sequence encoding:

(i) a Wuschel or Wuschel homeobox (WUS/WOX homeobox) polypeptide;

(ii) a Babyboom (BBM) polypeptide or an Ovule Development Protein 2 (ODP2) polypeptide; or (iii) a combination of (i) and (ii).

2. The method of claim 1, wherein the first bacterial group and the second bacterial group comprise a same bacterial strain.

3. The method of claim 2, wherein the same bacterial strain is a disarmed *Agrobacteria* strain selected from the group consisting of AGL-1, EHA105, GV3101, LBA4404, and LBA4404 THY.

4. The method of claim 2, wherein the same strain is an *Ochrobactrum haywardense* H1 strain.

5. The method of claim 1, wherein the first bacterial group and the second bacterial group comprise different bacterial strains.

6. The method of claim 5, wherein the different bacterial strains are selected from:

a disarmed *Agrobacteria* strain and an *Ochrobactrum haywardense* H1 strain.

7. The method of claim 6, wherein the different bacterial strains are selected from: the group consisting of AGL-1, EHA105, GV3101, LBA4404, and LBA4404 THY.

8. The method of claim 1, wherein the first bacterial group and the second bacterial group are present in a 50:50 ratio.

9. The method of claim 1, wherein the first bacterial group and the second bacterial group are present in a 75:25 ratio.

10. The method of claim 1, wherein the first bacterial group and the second bacterial group are present in a 90:10 ratio.

11. The method of claim 1, wherein the first bacterial group and the second bacterial group are present in a 95:5 ratio.

12. The method of claim 1, wherein the first bacterial group and the second bacterial group are present in a 99:1 ratio.

13. The method of claim 1, wherein the nucleotide sequence encodes the WUS/WOX homeobox polypeptide.

14. The method of claim 13, wherein the WUS/WOX homeobox polypeptide is selected from WUS1, WUS2, WUS3, WOX2A, WOX4, WOX5, and WOX9.

15. The method of claim 1, wherein the nucleotide sequence encodes the Babyboom (BBM) polypeptide or the Ovule Development Protein 2 (ODP2) polypeptide.

16. The method of claim 15, wherein the Babyboom (BBM) polypeptide is selected from BBM2, BMN2, and BMN3, or the Ovule Development Protein 2 (ODP2) polypeptide is ODP2.

17. The method of claim 1, wherein the nucleotide sequence encodes the WUS/WOX homeobox polypeptide and the Babyboom (BBM) polypeptide or the Ovule Development Protein 2 (ODP2) polypeptide.

18. The method of claim 17, wherein the WUS/WOX homeobox polypeptide is selected from WUS1, WUS2, WUS3, WOX2A, WOX4, WOX5, and WOX9, and the Babyboom (BBM) polypeptide is selected from BBM2, BMN2, and BMN3 or the Ovule Development Protein 2 (ODP2) polypeptide is ODP2.

19. The method of claim 1, wherein the trait gene expression cassette comprises:

a trait gene selected from the group of a gene conferring pest resistance, a gene conferring herbicide resistance, a gene conferring stress tolerance, a gene conferring drought resistance, a gene conferring nitrogen use efficiency (NUE), a gene conferring disease resistance, and a gene conferring an ability to alter a metabolic pathway.

20. The method of claim 2, wherein the first bacterial group and the second bacterial group are present in a 50:50 ratio.

21. The method of claim 2, wherein the first bacterial group and the second bacterial group are present in a 75:25 ratio.

22. The method of claim 2, wherein the first bacterial group and the second bacterial group are present in a 90:10 ratio.

23. The method of claim 2, wherein the first bacterial group and the second bacterial group are present in a 95:5 ratio.

24. The method of claim 2, wherein the first bacterial group and the second group are present in a 99:1 ratio.

25. The method of claim 5, wherein the first bacterial group and the second bacterial group are present in a 50:50 ratio.

26. The method of claim 5, wherein the first bacterial group and the second bacterial group are present in a 75:25 ratio.

27. The method of claim 5, wherein the first bacterial group and the second bacterial group are present in a 90:10 ratio.

28. The method of claim 5, wherein the first bacterial group and the second bacterial group are present in a 95:5 ratio.

29. The method of claim 5, wherein the first bacterial group and the second bacterial group are present in a 99:1 ratio.

30. The method of claim 1, wherein the morphogenic gene cassette is not inserted into the genome of the selected plant cell.

31. The method of claim 1, wherein the first bacterial group and the second bacterial group are present in a ratio of from 90:10 to 99:1, wherein the morphogenic gene expression cassette comprises a nucleotide sequence encoding a Wuschel or WOX polypeptide, and wherein the contacted maize plant cell is part of a maize immature embryo.

* * * * *